US009969998B2

(12) United States Patent
Thanos et al.

(10) Patent No.: US 9,969,998 B2
(45) Date of Patent: May 15, 2018

(54) COMPOSITIONS OF ADENOSINE DEAMINASE-2 (ADA2), VARIANTS THEREOF AND METHODS OF USING SAME

(71) Applicant: Halozyme, Inc., San Diego, CA (US)

(72) Inventors: Christopher D. Thanos, Tiburon, CA (US); Lin Wang, San Diego, CA (US); H. Michael Shepard, San Diego, CA (US)

(73) Assignee: Halozyme, Inc., San Diego, CA (US)

( * ) Notice: Subject to any disclaimer, the term of this patent is extended or adjusted under 35 U.S.C. 154(b) by 36 days.

(21) Appl. No.: 15/094,908

(22) Filed: Apr. 8, 2016

(65) Prior Publication Data

US 2016/0272960 A1 Sep. 22, 2016
US 2017/0166878 A9 Jun. 15, 2017

Related U.S. Application Data

(63) Continuation-in-part of application No. PCT/US2015/055613, filed on Oct. 14, 2015.

(60) Provisional application No. 62/063,936, filed on Oct. 14, 2014.

(51) Int. Cl.
C12N 9/78 (2006.01)
A61K 38/48 (2006.01)
A61K 38/00 (2006.01)

(52) U.S. Cl.
CPC ............... *C12N 9/78* (2013.01); *A61K 38/48* (2013.01); *C12Y 305/04004* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 2,488,564 A | 11/1949 | Singher et al. | 435/201 |
| 2,488,565 A | 11/1949 | Singher et al. | 435/201 |
| 2,676,139 A | 4/1954 | Tint et al. | 424/201 |
| 2,795,529 A | 6/1957 | Alburn et al. | 424/94.3 |
| 2,806,815 A | 9/1957 | Singher et al. | 435/188 |
| 2,808,362 A | 9/1957 | Thompson et al. | 435/201 |
| 3,536,809 A | 10/1970 | Applezweig | 424/28 |
| 3,598,123 A | 8/1971 | Zaffaroni | 424/435 |
| 3,630,200 A | 12/1971 | Higuchi | 424/427 |
| 3,710,795 A | 1/1973 | Higuchi et al. | 424/424 |
| 3,845,770 A | 11/1974 | Theeuwes et al. | 424/427 |
| 3,847,770 A | 11/1974 | Radlowe et al. | 204/159.23 |
| 3,916,899 A | 11/1975 | Theeuwes et al. | 424/424 |
| 4,002,531 A | 1/1977 | Royer | 435/188 |
| 4,008,719 A | 2/1977 | Theeuwes et al. | 424/427 |
| 4,044,126 A | 8/1977 | Cook et al. | 514/180 |
| 4,179,337 A | 12/1979 | Davis et al. | 435/181 |
| 4,364,923 A | 12/1982 | Cook et al. | 424/46 |
| 4,414,209 A | 11/1983 | Cook et al. | 514/180 |
| 4,687,660 A | 8/1987 | Baker et al. | 424/465 |
| 4,751,180 A | 6/1988 | Cousens et al. | 435/68 |
| 4,769,027 A | 9/1988 | Baker et al. | 424/493 |
| 4,935,233 A | 6/1990 | Bell et al. | 424/85.5 |
| 4,952,496 A | 8/1990 | Studier et al. | 435/91.41 |
| 5,033,252 A | 7/1991 | Carter | 53/425 |
| 5,052,558 A | 10/1991 | Carter | 206/439 |
| 5,059,595 A | 10/1991 | Le Grazie | 424/468 |
| 5,073,543 A | 12/1991 | Marshall et al. | 514/21 |
| 5,120,548 A | 6/1992 | McClelland et al. | 424/473 |
| 5,122,614 A | 6/1992 | Zalipsky | 548/520 |
| 5,323,907 A | 6/1994 | Kalvelage | 206/531 |
| 5,324,844 A | 6/1994 | Zalipsky | 548/520 |
| 5,349,001 A | 9/1994 | Greenwald et al. | 525/408 |
| 5,354,556 A | 10/1994 | Sparks | 424/419 |
| 5,446,090 A | 8/1995 | Harris | 525/54.1 |
| 5,457,035 A | 10/1995 | Baum et al. | 435/69.5 |
| 5,591,767 A | 1/1997 | Mohr et al. | 514/413 |
| 5,612,460 A | 3/1997 | Zalipsky | 530/391.9 |
| 5,639,476 A | 6/1997 | Oshlack et al. | 424/468 |
| 5,641,870 A | 6/1997 | Rinderknecht et al. | 530/417 |
| 5,643,575 A | 7/1997 | Martinez et al. | 424/194.1 |
| 5,648,260 A | 7/1997 | Winter et al. | 435/252.3 |
| 5,672,662 A | 9/1997 | Harris et al. | 525/408 |
| 5,674,533 A | 10/1997 | Santus et al. | 424/493 |
| 5,681,567 A | 10/1997 | Martinez et al. | 424/178.1 |
| 5,712,122 A | 1/1998 | Boime et al. | 435/69.7 |
| 5,716,613 A | 2/1998 | Gruber et al. | 424/93.2 |
| 5,716,826 A | 2/1998 | Gruber et al. | 435/320.1 |
| 5,731,168 A | 3/1998 | Carter et al. | 435/69.1 |

(Continued)

FOREIGN PATENT DOCUMENTS

| | | |
|---|---|---|
| EP | 1262193 | 4/2002 |
| EP | 0822199 | 9/2004 |

(Continued)

OTHER PUBLICATIONS

Letter/Written Disclosure of the Supplemental Information Disclosure Statement for the above-referenced application, filed herewith on Sep. 25, 2017, 2 pages.
Müller, D and R. Kontermann, "Recombinant bispecific antibodies for cellular cancer immunotherapy," Curr. Opin. Mol. Ther. 9(4):319-326 (2007).
Novellino et al., "A listing of human tumor antigens recognized by T cells: Mar. 2004 update," Cancer Immunol. Immunother. 54(3):187-207 (2005).
Rosengren et al., "PEGylated Recombinant Hyaluronidase PH2O (PEGPH2O) Enhances Checkpoint Inhibitor Efficacy in Syngeneic Mouse Models of Cancer," presented at AACR Annual Meeting, Apr. 20, 2016. New Orleans, LA. Poster #4886 [poster and enlarged individual panels], 13 pages.
Serra et al., "Pegylated adenosine deaminase 2 (PEG-ADA2) abrogates the cytoprotective effects of adenosine against chronic lymphocytic leukemia cells," presented at American Association for Cancer Research (AACR) Annual Meeting, Apr. 5, 2017. Washington D.C. Abstract #5583/15 [retrieved Mar. 17, 2017; available online Mar. 1, 2017], 2 pages.

(Continued)

Primary Examiner — James D Schultz
(74) Attorney, Agent, or Firm — Dentons US LLP; Stephanie Seidman

(57) ABSTRACT

Provided are variant adenosine deaminase 2 (ADA2) proteins, conjugates thereof and compositions containing the proteins and/or conjugates. Also provided are methods and uses of the ADA2 proteins or conjugates for treating diseases and conditions, such as a tumor or cancer, and in particular any disease or condition associated with elevated adenosine or other associated marker.

43 Claims, 7 Drawing Sheets

(56) References Cited

U.S. PATENT DOCUMENTS

| | | | |
|---|---|---|---|
| 5,733,566 A | 3/1998 | Lewis | 424/426 |
| 5,739,277 A | 4/1998 | Presta et al. | 530/326 |
| 5,747,027 A | 5/1998 | Stern et al. | 424/94.62 |
| 5,756,593 A | 5/1998 | Martinez et al. | 525/403 |
| 5,766,581 A | 6/1998 | Bartley et al. | 424/85.1 |
| 5,795,569 A | 8/1998 | Bartley et al. | 424/85.1 |
| 5,808,096 A | 9/1998 | Zalipsky | 548/520 |
| 5,827,721 A | 10/1998 | Stern et al. | 435/201 |
| 5,834,250 A | 11/1998 | Wells et al. | 435/7.1 |
| 5,846,951 A | 12/1998 | Gregoriadis | 514/54 |
| 5,851,529 A | 12/1998 | Guber et al. | 424/188.1 |
| 5,869,046 A | 2/1999 | Presta et al. | 424/133.1 |
| 5,900,461 A | 5/1999 | Harris | 525/54.11 |
| 5,919,455 A | 7/1999 | Greennnwald et al. | 424/178.1 |
| 5,932,462 A | 8/1999 | Harris et al. | 435/188 |
| 5,965,119 A | 10/1999 | Greenwald et al. | 424/78.37 |
| 5,968,780 A | 10/1999 | Fan et al. | 435/69.4 |
| 5,985,263 A | 11/1999 | Lee et al. | 424/85.2 |
| 5,990,237 A | 11/1999 | Bentley et al. | 525/54.2 |
| 6,030,613 A | 2/2000 | Blumberg et al. | 424/134.1 |
| 6,086,875 A | 7/2000 | Blumberg et al. | 424/134.1 |
| 6,096,871 A | 8/2000 | Presta et al. | 530/387.3 |
| 6,113,906 A | 9/2000 | Greenwald et al. | 424/194.1 |
| 6,121,022 A | 9/2000 | Presta et al. | 435/69.7 |
| 6,153,655 A | 11/2000 | Martinez et al. | 514/772.3 |
| 6,180,095 B1 | 1/2001 | Greenwald et al. | 424/85.1 |
| 6,194,551 B1 | 2/2001 | Idusogie et al. | 530/387.1 |
| 6,214,966 B1 | 4/2001 | Harris | 528/322 |
| 6,242,195 B1 | 6/2001 | Idusogie et al. | 435/7.1 |
| 6,251,382 B1 | 6/2001 | Greenwald et al. | 424/78.17 |
| 6,258,351 B1 | 7/2001 | Harris | 424/78.3 |
| 6,277,375 B1 | 8/2001 | Ward | 424/133.1 |
| 6,303,569 B1 | 10/2001 | Greenwald et al. | 514/1.3 |
| 6,340,742 B1 | 1/2002 | Burg et al. | 530/351 |
| 6,395,266 B1 | 5/2002 | Martinez et al. | 424/78.3 |
| 6,413,507 B1 | 7/2002 | Bentley et al. | 424/78 |
| 6,420,339 B1 | 7/2002 | Gegg et al. | 514/12 |
| 6,428,968 B1 | 8/2002 | Molnar-Kimber et al. | 435/7.23 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,485,726 B1 | 11/2002 | Blumberg et al. | 424/178.1 |
| 6,495,659 B2 | 12/2002 | Bentley et al. | 528/425 |
| 6,528,624 B1 | 3/2003 | Idusogie et al. | 530/387.3 |
| 6,538,124 B1 | 3/2003 | Idusogie et al. | 536/23.5 |
| 6,624,142 B2 | 9/2003 | Greenwald et al. | 514/2 |
| 6,632,670 B1 | 10/2003 | Wadsworth et al. | 435/455 |
| 6,635,472 B1 | 10/2003 | Lauermann | 435/320.1 |
| 6,638,499 B2 | 10/2003 | Martinez et al. | 424/78.3 |
| 6,639,139 B2 | 10/2003 | Muller | 84/483.1 |
| 6,653,103 B2 | 11/2003 | Petersen et al. | 435/69.1 |
| 6,682,736 B1 | 1/2004 | Hanson et al. | 424/144.1 |
| 6,689,871 B1 | 2/2004 | Wolfe et al. | 530/412 |
| 6,696,245 B2 | 2/2004 | Winter et al. | 435/6 |
| 6,720,306 B2 | 4/2004 | Greenwald et al. | 514/18 |
| 6,723,316 B2 | 4/2004 | Laquerre et al. | 424/93.2 |
| 6,737,056 B1 | 5/2004 | Presta | 424/133.1 |
| 6,737,505 B2 | 5/2004 | Bentley et al. | 528/425 |
| 6,821,505 B2 | 11/2004 | Ward | 424/9.1 |
| 6,824,766 B2 | 11/2004 | Greenwald et al. | 424/78.18 |
| 6,828,401 B2 | 12/2004 | Nho et al. | 526/333 |
| 6,858,736 B2 | 2/2005 | Nho et al. | 546/290 |
| 6,897,045 B2 | 5/2005 | Engelhardt et al. | 435/69.6 |
| 6,984,720 B1 | 1/2006 | Korman et al. | 530/388.22 |
| 6,998,253 B1 | 2/2006 | Presta et al. | 435/69.1 |
| 7,001,765 B2 | 2/2006 | Maass et al. | 435/320.1 |
| 7,033,826 B2 | 4/2006 | Perricaudet et al. | 435/320.1 |
| 7,083,784 B2 | 8/2006 | Dall'Acqua et al. | 424/130.1 |
| 7,087,229 B2 | 8/2006 | Zhao et al. | 424/179.1 |
| 7,122,189 B2 | 10/2006 | Zhao et al. | 424/179.1 |
| 7,153,510 B1 | 12/2006 | Rose | 424/199.1 |
| 7,172,893 B2 | 2/2007 | Rabinowitz et al. | 435/471 |
| 7,238,526 B2 | 7/2007 | Wilson et al. | 435/382 |
| 7,241,447 B1 | 7/2007 | Engelhardt et al. | 424/193.1 |
| 7,317,091 B2 | 1/2008 | Lazar et al. | 530/387.1 |
| 7,375,078 B2 | 5/2008 | Feng | 514/2 |
| 7,404,956 B2 | 7/2008 | Peters et al. | 424/178.1 |
| 7,537,924 B2 | 5/2009 | Coffin | 435/235.1 |
| 7,550,296 B2 | 6/2009 | Hermiston et al. | 435/473 |
| 7,569,657 B2 | 8/2009 | Zhao et al. | 528/422 |
| 7,662,627 B2 | 2/2010 | Johnson, Jr. | 435/367 |
| 7,731,952 B2 | 6/2010 | Mohr et al. | 424/92.3 |
| 7,731,974 B2 | 6/2010 | Bell et al. | 424/199.1 |
| 7,767,429 B2 | 8/2010 | Bookbinder et al. | 435/201 |
| 7,811,814 B2 | 10/2010 | Bohn et al. | 435/320.1 |
| 7,846,445 B2 | 12/2010 | Schellenberger et al. | 424/180.1 |
| 7,855,279 B2 | 12/2010 | Schellenberger et al. | 530/399 |
| 7,868,131 B2 | 1/2011 | Zhao et al. | 528/398 |
| 7,897,146 B2 | 3/2011 | Brown et al. | 424/93.1 |
| 7,906,111 B2 | 3/2011 | Wilson et al. | 424/93.2 |
| 7,927,585 B2 | 4/2011 | Snyder | 424/93.2 |
| 7,943,374 B2 | 5/2011 | Hildinger | 435/320.1 |
| 7,943,743 B2 | 5/2011 | Korman et al. | 530/388.15 |
| 7,968,340 B2 | 6/2011 | Hallek et al. | 435/440 |
| 8,007,780 B2 | 8/2011 | Arbetman et al. | 424/93.2 |
| 8,008,449 B2 | 8/2011 | Korman et al. | 530/388.15 |
| 8,217,149 B2 | 7/2012 | Irving et al. | 530/387.1 |
| 8,450,470 B2 | 5/2013 | Bookbinder et al. | 536/23.2 |
| 8,465,743 B2 | 6/2013 | Rosenberg et al. | 424/134.1 |
| 8,679,767 B2 | 3/2014 | Kaur et al. | 435/7.1 |
| 8,735,553 B1 | 5/2014 | Li et al. | 530/388.22 |
| 8,741,283 B2 | 6/2014 | Filpula et al. | 424/94.4 |
| 8,779,105 B2 | 7/2014 | Korman et al. | 530/388.1 |
| 8,779,108 B2 | 7/2014 | Queva et al. | 530/388.73 |
| 8,784,791 B2 | 7/2014 | Kozlowski | 424/78.17 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0086014 A1 | 7/2002 | Korman et al. | 424/144.1 |
| 2002/0156047 A1 | 10/2002 | Zhao | 514/58 |
| 2003/0069395 A1 | 4/2003 | Sato et al. | 530/350 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0220447 A1 | 11/2003 | Harris | 528/322 |
| 2003/0235536 A1 | 12/2003 | Blumberg et al. | 424/45 |
| 2004/0009604 A1 | 1/2004 | Zhang et al. | 435/456 |
| 2004/0013637 A1 | 1/2004 | Bentley et al. | 424/78.17 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0158273 A1 | 7/2005 | Harris | 424/78.27 |
| 2005/0171328 A1 | 8/2005 | Harris | 528/322 |
| 2005/0180969 A1 | 8/2005 | Hardy et al. | 424/141.1 |
| 2005/0209416 A1 | 9/2005 | Harris | 525/523 |
| 2005/0220818 A1 | 10/2005 | Lorence | 424/214.1 |
| 2005/0256191 A1 | 11/2005 | Denny et al. | 514/554 |
| 2005/0260186 A1 | 11/2005 | Bookbinder et al. | 424/94.62 |
| 2005/0260601 A1 | 11/2005 | Whitt et al. | 435/6 |
| 2006/0008883 A1 | 1/2006 | Lazar et al. | 435/69.7 |
| 2006/0024298 A1 | 2/2006 | Lazar et al. | 530/387.1 |
| 2006/0039894 A1 | 2/2006 | Mohr et al. | 424/93.6 |
| 2006/0104968 A1 | 5/2006 | Bookbinder et al. | 424/94.62 |
| 2007/0098743 A1 | 5/2007 | Bell et al. | 424/224.1 |
| 2007/0110720 A1 | 5/2007 | Brown et al. | 424/93.2 |
| 2007/0166281 A1 | 7/2007 | Kosak | 424/85.1 |
| 2007/0173615 A1 | 7/2007 | Zhao et al. | 525/408 |
| 2007/0191597 A1 | 8/2007 | Jain et al. | 536/4.1 |
| 2007/0231329 A1 | 10/2007 | Lazar et al. | 424/144.1 |
| 2007/0237505 A1 | 10/2007 | Lazar et al. | 424/133.1 |
| 2007/0237766 A1 | 10/2007 | Lazar et al. | 424/133.1 |
| 2007/0237767 A1 | 10/2007 | Lazar et al. | 424/133.1 |
| 2007/0243188 A1 | 10/2007 | Lazar et al. | 424/133.1 |
| 2007/0248603 A1 | 10/2007 | Lazar et al. | 424/134.1 |
| 2007/0286859 A1 | 12/2007 | Lazar et al. | 424/133.1 |
| 2008/0004206 A1 | 1/2008 | Rosen et al. | 514/2 |
| 2008/0057056 A1 | 3/2008 | Lazar et al. | 424/130.1 |
| 2008/0153751 A1 | 6/2008 | Rosen et al. | 514/12 |
| 2008/0161243 A1 | 7/2008 | Rosen et al. | 514/12 |
| 2008/0194481 A1 | 8/2008 | Rosen et al. | 514/12 |
| 2008/0261877 A1 | 10/2008 | Balance et al. | 514/12 |
| 2009/0010889 A1 | 1/2009 | Brown et al. | 424/93.2 |

(56) References Cited

U.S. PATENT DOCUMENTS

| | | |
|---|---|---|
| 2009/0074787 A1 | 3/2009 | Gomez-Navarro et al. ............ 424/142.1 |
| 2009/0087411 A1 | 4/2009 | Fares et al. ............ 424/85.6 |
| 2009/0092582 A1 | 4/2009 | Bogin et al. ............ 424/85.5 |
| 2009/0215147 A1 | 8/2009 | Zhang et al. ............ 435/235.1 |
| 2009/0274728 A1 | 11/2009 | Brown et al. ............ 424/235.1 |
| 2009/0285860 A1 | 11/2009 | Martuza et al. ............ 424/277.1 |
| 2010/0092515 A1 | 4/2010 | Conner et al. ............ 424/231.1 |
| 2010/0113567 A1 | 5/2010 | Barber ............ 514/44 R |
| 2010/0136549 A1 | 6/2010 | Christiansen et al. ............ 702/19 |
| 2010/0143457 A1 | 6/2010 | Wei et al. ............ 424/450 |
| 2010/0172877 A1 | 7/2010 | van den Pol et al. ............ 424/93.6 |
| 2010/0178684 A1 | 7/2010 | Woo et al. ............ 435/235.1 |
| 2010/0239554 A1 | 9/2010 | Schellenberger et al. ... 424/94.3 |
| 2010/0292130 A1 | 11/2010 | Skerra et al. ............ 514/1.1 |
| 2010/0323956 A1 | 12/2010 | Schellenberger et al. ..... 514/7.2 |
| 2011/0046060 A1 | 2/2011 | Schellenberger et al. ... 514/13.7 |
| 2011/0046061 A1 | 2/2011 | Schellenberger et al. ... 514/13.7 |
| 2011/0077199 A1 | 3/2011 | Schellenberger et al. ... 514/11.3 |
| 2011/0152359 A1 | 6/2011 | Bookbinder et al. ......... 435/200 |
| 2011/0158948 A1 | 6/2011 | Brown et al. ............ 424/93.2 |
| 2011/0172146 A1 | 7/2011 | Schellenberger et al. ..... 514/4.7 |
| 2011/0177032 A1 | 7/2011 | Martuza et al. ............ 424/93.2 |
| 2011/0212530 A1 | 9/2011 | Baltimore et al. ............ 435/455 |
| 2012/0108455 A1 | 5/2012 | Kodandapani et al. .......... 506/9 |
| 2012/0148535 A1 | 6/2012 | Carrió et al. ............ 424/93.2 |
| 2012/0178691 A1 | 7/2012 | Schellenberger et al. ... 514/14.1 |
| 2012/0263701 A1 | 10/2012 | Schellenberger et al. ... 424/94.3 |
| 2013/0017997 A1 | 1/2013 | Schellenberger et al. ... 514/14.1 |
| 2013/0034559 A1 | 2/2013 | Queva et al. ............ 424/139.1 |
| 2013/0045202 A1 | 2/2013 | Irving et al. ............ 424/133.1 |
| 2013/0224228 A1 | 8/2013 | Jackson et al. ............ 424/179.1 |
| 2013/0266579 A1 | 10/2013 | Wei et al. ............ 424/158.1 |
| 2013/0302275 A1 | 11/2013 | Wei et al. ............ 424/94.62 |
| 2015/0064154 A1 | 3/2015 | Georgiou et al. .......... 424/93.71 |

FOREIGN PATENT DOCUMENTS

| | | |
|---|---|---|
| EP | 1520175 | 7/2007 |
| EP | 1064951 | 8/2007 |
| EP | 1606411 | 10/2008 |
| EP | 1385466 | 3/2011 |
| WO | WO 1998/005787 | 2/1988 |
| WO | WO 1988/007089 | 9/1988 |
| WO | WO 1993/010151 | 5/1993 |
| WO | WO 1994/28024 | 12/1994 |
| WO | WO 1996/014339 | 5/1996 |
| WO | WO 1997/042308 | 11/1997 |
| WO | WO 1998/023289 | 6/1998 |
| WO | WO 1998/035039 | 8/1998 |
| WO | WO 1998/050431 | 11/1998 |
| WO | WO 1999/051642 | 10/1999 |
| WO | WO 1999/058572 | 11/1999 |
| WO | WO 2000/002017 | 1/2000 |
| WO | WO 2000/009560 | 2/2000 |
| WO | WO 2000/032767 | 6/2000 |
| WO | WO 2000/037504 | 6/2000 |
| WO | WO 2000/042072 | 7/2000 |
| WO | WO 2001/076640 | 10/2001 |
| WO | WO 2001/087922 | 11/2001 |
| WO | WO 2001/087925 | 11/2001 |
| WO | WO 2002/044215 | 6/2002 |
| WO | WO 2002/049673 | 6/2002 |
| WO | WO 2002/060919 | 8/2002 |
| WO | WO 2003/074569 | 9/2003 |
| WO | WO 2003/077834 | 9/2003 |
| WO | WO 2004/016750 | 2/2004 |
| WO | WO 2004/029207 | 4/2004 |
| WO | WO 2004/035752 | 4/2004 |
| WO | WO 2004/044859 | 5/2004 |
| WO | WO 2004/063351 | 7/2004 |
| WO | WO 2004/074455 | 9/2004 |
| WO | WO 2004/099249 | 11/2004 |
| WO | WO 2005/000099 | 1/2005 |
| WO | WO 2005/000360 | 1/2005 |
| WO | WO 2005/040217 | 5/2005 |
| WO | WO 2005/063816 | 7/2005 |
| WO | WO 2005/070963 | 8/2005 |
| WO | WO 2005/077981 | 8/2005 |
| WO | WO 2005/092925 | 10/2005 |
| WO | WO 2005/118799 | 12/2005 |
| WO | WO 2005/123780 | 12/2005 |
| WO | WO 2006/019447 | 2/2006 |
| WO | WO 2006/047350 | 5/2006 |
| WO | WO 2006/085967 | 8/2006 |
| WO | WO 2007/021494 | 2/2007 |
| WO | WO 2007/149686 | 12/2007 |
| WO | WO 2008/033413 | 3/2008 |
| WO | WO 2008/034119 | 3/2008 |
| WO | WO 2008/131208 | 10/2008 |
| WO | WO 2008/155134 | 12/2008 |
| WO | WO 2008/156712 | 12/2008 |
| WO | WO 2009/058322 | 5/2009 |
| WO | WO 2009/111066 | 9/2009 |
| WO | WO 2010/027827 | 3/2010 |
| WO | WO 2010/077634 | 7/2010 |
| WO | WO 2010/091122 | 8/2010 |
| WO | WO 2010/140148 | 12/2010 |
| WO | WO 2010/144502 | 12/2010 |
| WO | WO 2010/144508 | 12/2010 |
| WO | WO 2011/028228 | 3/2011 |
| WO | WO 2011/028229 | 3/2011 |
| WO | WO 2011/028344 | 3/2011 |
| WO | WO 2011/066342 | 6/2011 |
| WO | WO 2011/069164 | 6/2011 |
| WO | WO 2012/006623 | 1/2012 |
| WO | WO 2012/006633 | 1/2012 |
| WO | WO 2012/006635 | 1/2012 |
| WO | WO 2012/031744 | 3/2012 |
| WO | WO 2012/079000 | 6/2012 |
| WO | WO 2012/109387 | 8/2012 |
| WO | WO 2013/019906 | 2/2013 |
| WO | WO 2013/059593 | 4/2013 |
| WO | WO 2014/011988 | 1/2014 |
| WO | WO 2014/186469 | 11/2014 |
| WO | WO 2015/112626 | 7/2015 |
| WO | WO 2016/061286 | 4/2016 |

OTHER PUBLICATIONS

Torley et al., "American Association for Cancer Research Investor Meeting: Targeting the Tumor Microenvironment," presented at American Association for Cancer Research (AACR) Annual Meeting, Apr. 18, 2016. New Orleans, LA [presentation], 91 pages.

Wang et al., "Enzymatic Depletion of Adenosine by Pegylated, Engineered Adenosine Deaminase 2 (PEG-ADA2): A Novel Immunotherapeutic Approach to Treat Solid Tumors," presented at American Association for Cancer Research (AACR) Annual Meeting, Apr. 18, 2016, New Orleans, LA. Poster #1472 [poster and enlarged individual panels], 8 page.

Response, filed Aug. 15, 2016, to International Search Report and Written Opinion, dated May 6, 2016, issued in connection with International Patent Application No. PCT/US2015/055613, 13 pages.

Written Opinion of the International Preliminary Examing Authority (PCT Rule 66), dated Sep. 21, 2016, in connection with International Patent Application No. PCT/US2015/055613 [D2=WO 2005/000099], 7 pages.

Response, filed Nov. 21, 2016, Written Opinion of the International Preliminary Examing Authority (PCT Rule 66), dated Sep. 21, 2016, in connection with International Patent Application No. PCT/US2015/055613, 18 pages.

International Preliminary Report on Patentability, dated Dec. 12, 2016, in connection with International Patent Application No. PCT/US2015/055613, 10 pages.

Examination Report, dated Sep. 19, 2017, in connection with European Patent Application No. 15797486.6, 4 pages.

Assays for Cell Proliferation Studies, Genetic Eng. Biotechnol. News. 26(6), retrieved from <URL:genengnews.com/keywordsandtools/print/1/11675/ [retrieved on Nov. 5, 2015], 6 pages.

(56) References Cited

OTHER PUBLICATIONS

Adams et al., "The c-myc oncogene driven by immunoglobulin enhancers induces lymphoid malignancy in transgenic mice," Nature 318:533-538 (1985).
Adams, G.E. and I.J. Stratford, "Bioreductive drugs for cancer therapy: the search for tumor specificity," Int. J. Radiat. Oncol. Biol. Phys., 29(2): 231-238 (1994).
Alexander et al., "Expression of the c-myc oncogene under control of an immunoglobulin enhancer in E mu-myc transgenic mice," Mol. Cell Biol. 7:1436-1444 (1987).
Altschul, S., "Basic local alignment search tool," J Molec Biol 215(3):403-410 (1990).
Ansel, Introduction to Pharmaceutical Dosage Forms, Fourth Edition, p. 126 (1985).
Antonioli et al., "Immunity, inflammation and cancer: a leading role for adenosine," Nat. Rev. Cancer 13(12):842-857 (2013).
Ashkenazi et al.,"Protection against endotoxic shock by a tumor necrosis factor receptor immunoadhesin," PNAS 88:10535-10539 (1991).
Beigier-Bompadre et al., "The formyl peptide N-formyl-methionyl-leucyl-phenylalanine downregulates the expression of FcgammaRs in interferon-gamma-activated monocytes/macrophages in vitro in vivo," Scand. J. Immunol. 57:221-228 (2003).
Belot et al., "Mutations in CECR1 associated with a neutrophil signature in peripheral blood," Pediatric Rheumatology 12:44 (2014).
Bernoist, C. and P. Chambon, "In vivo sequence requirements of the SV40 early promotor region," Nature 290:304-310 (1981).
Bhujwalla et al., "Combined vascular and extracellular pH imaging of solid tumors" NMR Biomed., 15(2):114-119 (2002).
Bianchi et al., "Synthetic depsipeptide substrates for the assay of human hepatitis C virus protease," Anal. Biochem. 237: 239-244 (1996).
Blay, J. (2012) Encylopedia of Cancer pp. 49-52.
Bordier et al., "Phase separation of integral membrane proteins in Triton X-114 solution," J. Biol. Chem., 256:1604-7 (1981).
Bouffard et al., "An in vitro assay for hepatitis C virus NS3 serine proteinase," Virology 209:52-59 (1995).
Bras et al., "Mutant ADA2 in vasculopathies," N. Engl. J. Med. 371(5):478-480 (2014).
Brinster et al., "Regulation of metallothionein—thymidine kinase fusion plasmids injected into mouse eggs," Nature 296:39-42 (1982).
Brown et al., "Codon utilisation in the pathogenic yeast, Candida albicans," Nucleic Acids Res. 19(15):4298 (1991).
Busch, S.J. and P. Sassone-Corsi, "Dimers, leucine zippers and DNA-binding domains," Trends Genetics, 6:36-40 (1990).
Byrn et al., "Biological properties of a CD4 immunoadhesin," Nature, 344:(6267)667-670 (1990).
Caliceti et al., "Biopharmaceutical properties of uricase conjugated to neutral and amphiphilic polymers," Bioconjug. Chem. 10(4):638-646 (1999).
Callahan et al., "Anti-CTLA-4 antibody therapy: immune monitoring during clinical development of a novel immunotherapy," Semin Oncol. 37(5):473-484 (2010).
Capon et al., "Designing CD4 immunoadhesins for AIDS therapy," Nature 337(6207):525-531 (1989).
Carlsson et al., "Protein thiolation and reversible protein-protein conjugation. N-Succinimidyl 3-(2-pyridyldithio)propionate, a new heterobifunctional reagent," Biochem. J. 173(3):723-737 (1978).
Carrillo, H. and D. Lipman, "The multiple-sequence alignment problem in biology," SIAM J Applied Math 48:1073-1082 (1988).
Carroll and Ashcroft, "Targeting the molecular basis for tumour hypoxia," Expert. Rev. Mol. Med. 7(6):1-16 (2005).
Chapman et al., "Therapeutic antibody fragments with prolonged in vivo half-lives," Nature Biotech. 17:780-783 (1999).
Chaudhuri et al., High-throughput biophysical analysis of protein therapeutics to examine interrelationships between aggregate formation and conformational stability, AAPS J. 16(1):48-64 (2014).

Cho et al., "Construction of hepatitis C-SIN virus recombinants with replicative dependency on hepatitis C virus serine protease activity," J. Virol. Meth. (65):201-207 (1997).
Cho et al., "Polysialic acid engineering: synthesis of polysialylated neoglycosphingolipids by using the polysialyltransferase from neuroinvasive Escherichia coli K1," Proc. Natl. Acad. Sci. 91(24):11427-11431(1994).
Cumber et al., "Structural features of the antibody—A chain linkage that influence the activity and stability of ricin A chain immunotoxins," Bioconj. Chem. 3(5):397-401 (1992).
Daddona and Kelley, "Characteristics of an aminohydrolase distinct from adenosine deaminase in cultured human lymphoblasts," Biochim. Biophys. Acta 658(2):280-290 (1981).
Danilkovitch-Miagkova, et al., "Hyaluronidase 2 negatively regulates RON receptor tyrosine kinase and mediates transformation of epithelial cells by jaagsiekte sheep retrovirus," Proc Natl Acad Sci US A. 100(8):4580-4585 (2003).
DeBoer et al., "The tac promoter: a functional hybrid derived from the trp and lac promoters," Proc. Natl. Acad. Sci. USA 80:21-25 (1983).
Delgado et al. "The uses and properties of PEG-linked proteins," Crit. Rev. Ther. Drug Carrier Syst. 9(3-4):249-304 (1992).
Dennis et al., "Albumin binding as a general strategy for improving the pharmacokinetics of proteins," 277(38):35035-35043 (2002).
Devereux, J., et al, "A comprehensive set of sequence analysis programs for the VAX," Nucleic Acids Research 12:387 (1984).
D'Souza et al., "In vitro cleavage of hepatitis C virus polyprotein substrates by purified recombinant NS3 protease," J. Gen. Virol. 76:1729-1736 (1995).
Dunn et al.; "The immunobiology of cancer immunosurveillance and immunoediting," Immunity 21(2):137-148 (2004).
Edelman et al., "The covalent structure of an entire gammaG immunoglobulin molecule," Proc Natl. Acad. Sci. USA 63(1):78-85 (1969).
Eisenberg et al., "Hydrophobic Moments and Protein Structure", Faraday Symp. Chem. Soc. 17:109-120 (1982).
Fattom et al., "Comparative immunogenicity of conjugates composed of the Staphylococcus aureus type 8 capsular polysaccharide bound to carrier proteins by adipic acid dihydrazide or N-succinimidyl-3-(2-pyridyldithio)propionate," Infect Immun. 60(2):584-589 (1992).
Filocamo et al., "Chimeric Sindbis viruses dependent on the NS3 protease of hepatitis C virus," J.Virology 71:1417-1427 (1997).
Fogh-Andersen et al., "Composition of interstitial fluid," Clin. Chem., 41(10):1522-1525 (1995).
Forsburg, S.L., "Codon usage table for Schizosaccharomyces pombe," Yeast. 10(8):1045-1047 (1994).
Frese et al.,"nab-Paclitaxel potentiates gemcitabine activity by reducing cytidine deaminase levels in a mouse model of pancreatic cancer." Cancer Discovery, 2:260-269 (2012).
Frost et al., "Purification, cloning, and expression of human plasma hyaluronidase," Biochem. Biophys. Res. Commun. 236:10-15 (1997).
Frost et al., "A microtiter-based assay for hyaluronidase activity not requiring specialized reagents," Anal. Biochem., 251:263-269 (1997).
Gardner et al., "The complete nucleotide sequence of an infectious clone of cauliflower mosaic virus by M13mp7 shotgun sequencing," Nucleic Acids Res. 9:2871-2888 (1981).
Garg et al., "Novel adenosine deaminase 2 mutations in a child with a fatal vasculopathy," Eur. J. Pediatr. 173(6):827-830 (2014).
Gentz et al., "Parallel association of Fos and Jun leucine zippers juxtaposes DNA binding domains," Science, 243(4899):1695-1699 (1989).
German et al., "A radioenzymatic assay for plasma adenosine," Anal. Biochem. 142(2):536-541 (1984).
Gerweck and Seetharaman, "Cellular pH gradient in tumor versus normal tissue: potential exploitation for the treatment of cancer" Cancer Res. 56(6):1194-1198 (1996).
Gilbert, W. and L. Villa-Komaroff, "Useful Proteins from Recombinant Bacteria," Scientific American 242(4):74-94 (1980).

(56) References Cited

OTHER PUBLICATIONS

Gilboa et al., "Use of oligonucleotide aptamer ligands to modulate the function of immune receptors," Clin Cancer Res 19(5):1054-1062 (2013).
Gordon et al., "Topographical localization of the C-terminal region of the voltage-dependent sodium channel from Electrophorus electricus using antibodies raised against a synthetic peptide," Proc. Natl. Acad Sci. 84(1):308-312 (1987).
Gribskov, M. and R. Burgess, "Sigma factors from E. coli, B. subtilis, phage SP01, and phage T4 are homologous proteins," Nucl. Acids Res. 14:6745-6763 (1986).
Griffin, A.M. and Griffin, H.G. (eds) "Methods in Molecular Biology, vol. 24: Computer Analysis of Sequence Data, Part I." New Jersey: The Humana Press, Inc. pp. 1-8 (1994).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Hahm et al., "Generation of a novel poliovirus with a requirement of hepatitis C virus protease NS3 activity," Virology 226:318-326 (1996).
Hamatake et al., "Establishment of an in vitro assay to characterize hepatitis C virus NS3-4A protease trans-processing activity," Intervirology 39:249-258 (1996).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature 315(6015):115-122 (1985).
Harris, J. and R Chess, "Effect of pegylation on pharmaceuticals," Nat Rev Drug Discov 2(3):214-221 (2003).
Hasko et al., "Regulation of inflammation by adenosine," Front. Immunol. 4:85 (2013).
Helmlinger et al., "Interstitial pH and pO2 gradients in solid tumors in vivo: high-resolution measurements reveal a lack of correlation," Nature Med., 3(2):177-182 (1997).
Herrera-Estrella et al., "Expression of chimaeric genes transferred into plant cells using a ti-plasmid-derived vector," Nature 303:209-213 (1983).
Herrera-Estrella et al., "Light-inducible and chloroplast-associated expression of a chimaeric gene introduced into Nicotiana tabacum using a Ti plasmid vector," Nature 310(5973):115-120 (1984).
Hershfield, M.S., "New insights into adenosine-receptor-mediated immunosuppression and the role of adenosine in causing the immunodeficiency associated with adenosine deaminase deficiency," Eur. J. Immunol. 35(1):25-30 (2005).
Hirose et al., "A dot-blot assay for heparin-binding proteins," Anal. Biochem. 156(2):320-325 (1986).
Hollenbaugh and Aruffo, "Construction of Immnoglobulin Fusion Proteins," in Current Protocols in Immunology, Chapter 10:Unit 10.19A (2002).
Holt et al., "Anti-serum albumin domain antibodies for extending the half-lives of short lived drugs," Protein Eng. Des. Sel. 21(5):283-288 (2008).
Howard et al., "Measurement of adenosine concentration in aqueous and vitreous," Invest. Opthalmol. Vis. Sci. 39(10):1942-1946 (1998).
Huang et al., "Claudin-3 gene silencing with siRNA suppresses ovarian tumor growth and metastasis," Proc Natl Acad Sci U S A. 106(9):3426-3430 (2009).
Huston et al.,"Protein engineering of antibody binding sites: recovery of specific activity in an anti-digoxin single-chain Fv analogue produced in Escherichia coli," Proc Natl Acad Sci USA 85(16):5879-5883 (1988).
Itano et al., Altered hyaluronan biosynthesis in cancer progression. Seminars in cancer biology 18:268-274 (2008).

Ito et al., "Cultivation of hepatitis C virus in primary hepatocyte culture from patients with chronic hepatitis C results in release of high titre infectious virus," J. Gen. Virol. 77:1043-1054 (1996).
IUPAC-IUB Commission on Biochemical Nomenclature, "A One-Letter Notation for Amino Acid Sequences: Tentative Rules," J. Biol. Chem. 243:3557-3559 (1968).
IUPAC-IUB, "Abbreviated nomenclature of synthetic poypeptides-polymerized amino acids-revised recommendations," Commission on Biochemical Nomenclature, Biochemistry 11:1726-1731 (1972).
Iwaki-Egawa et al., "Human plasma adenosine deaminase 2 is secreted by activated monocytes," Biol. Chem. 387(3):319-321 (2006).
Jackson et al., "Development and application of a simple microassay for adenosine in rat plasma," Hypertension 10(2) 189-197 (1987).
Jay et al., "Construction of a general vector for efficient expression of mammalian proteins in bacteria: use of a synthetic ribosome binding site," Proc. Nati. Acad. Sci. USA 78:5543-5548 (1981).
Kato et al., "Acidic extracellular microenvironment and cancer," Cancer Cell Int. 13(1):89 (2013).
Kegler-Ebo et al., "Codon cassette mutagenesis: a general method to insert or replace individual codons by using universal mutagenic cassettes," Nucleic Acids Research, 22(9):1593-1599 (1994).
Keir et al., "PD-1 and its ligands in tolerance and immunity," Annu Rev Immunol 26:677-704 (2008).
Kelsey et al., "Species- and tissue-specific expression of human alpha 1-antitrypsin in transgenic mice," Genes and Devel. 1:161-171 (1987).
Kirkwood et al., "Phase II trial of tremelimumab (CP-675,206) in patients with advanced refractory or relapsed melanoma," Clin Cancer Res 16(3):1042-1048 (2010).
Kollias et al., "Regulated expression of human A gamma-, beta-, and hybrid gamma beta-globin genes in transgenic mice: manipulation of the developmental expression patterns," Cell 46:89-94 (1986).
Konig et al., "Use of an albumin-binding domain for the selective immobilisation of recombinant capture antibody fragments on ELISA plates," J. Immunol. Methods 218(1-2):73-83 (1998).
Kraulis et al., "The serum albumin-binding domain of the streptococcal protein G is a three-helical bundle: a heteronuclear NMR study," FEBS Lett. 378(2):190-194 (1996).
Krumlauf et al., Developmental regulation of alpha-fetoprotein genes in transgenic mice, Mol. Cell. Biol. 5:1639-1648 (1985).
Krupers et al., "Complexation of poly(ethylene oxide) with poly(acrylic acid-co-hydroxyethyl methacrylate)s," Eur. Polym J. 32:785-790 (1996).
Kyi et al., "Checkpoint blocking antibodies in cancer immunotherapy," FEBS Letters 588:368-376 (2014).
Lalancette et al, "Characterization of an 80-kilodalton bull sperm protein identified as PH-20," Biol Reprod. 65(2):628-636 (2001).
Leder et al., "Consequences of widespread deregulation of the c-myc gene in transgenic mice: multiple neoplasms and normal development," Cell 45:485-495 (1986).
Linhult et al., "Mutational analysis of the interaction between albumin-binding domain from Streptococcal protein G and human serum albumin," Protein Sci. 11(2):206-213 (2002).
Liu et al., "Improved mouse models to assess tumour immunity and irAEs after combination cancer immunotherapies," Clin. Transl. Immunology 3(8):e22 (2014).
Lu, H. and E. Wimmer., "Poliovirus chimeras replicating under the translational control of genetic elements of hepatitis C virus reveal unusual properties of the internal ribosomal entry site of hepatitis C virus," Proc. Natl. Acad. Sci. USA 93:1412-1417 (1996).
Lu et al., "Development of a rapid, microplate-based kinetic assay for measuring adenosine deaminase activity in body fluids," Clin. Chim. Acta 413:1637-1640 (2012).
Macdonald, R., "Expression of the pancreatic elastase I gene in transgenic mice," Hepatology 7:42S-51S (1987).
Maghni et al., "Suitability of cell metabolic colorimetric assays for assessment of CD4+ T cell proliferation: comparison to 5-bromo-2-deoxyuridine (BrdU) ELISA," J. Immunol. Method. 223(2):185-194 (1999).
Magram et al., "Developmental regulation of a cloned adult beta-globin gene in transgenic mice," Nature 315:338-340 (1985).

(56) References Cited

OTHER PUBLICATIONS

Mahan et al, "Phase change enzyme immunoassay," Anal. Biochem. 162(1):163-170 (1987).
Maier et al., "Phylogenetic analysis reveals a novel protein family closely related to adenosine deaminase," J. Mol. Evol. 61(6):776-794 (2005).
Mason et al., "The hypogonadal mouse: reproductive functions restored by gene therapy," Science 234:1372-1378 (1986).
Mehvar et al., "Modulation of the pharmacokinetics and pharmacodynamics of proteins by polyethylene glycol conjugation," J. Pharm. Pharmaceut. Sci. 3(1):125-136 (2000).
Merrifield, J., "Solid phase peptide synthesis. I. The synthesis of a tetrapeptide," J Am Chem Soc 85:2149-2154 (1963).
Mizutani et al., Characterization of hepatitis C virus replication in cloned cells obtained from a human T-cell leukemia virus type 1-infected cell line, MT-2, J.Virol. 70:7219-7223 (1996).
Mizutani et al., "Inhibition of hepatitis C virus replication by antisense oligonucleotide in culture cells," Biochem. Biophys. Res. Commun. 212:906-911 (1995).
Mizutani et al., "Long-term human T-cell culture system supporting hepatitis C virus replication," Biochem. Biophys. Res. Commun. 227:822-826 (1996).
Monfardini et al, "A branched monomethoxypoly(ethylene glycol) for protein modification," Bioconjugate Chem. 6: 62-69 (1995).
Morpurgo et al., "Covalent modification of mushroom tyrosinase with different amphiphic polymers for pharmaceutical and biocatalysis applications," Appl. Biochem. Biotechnol. 56(1):59-72 (1996).
Navon Elkan, et al., "Mutant adenosine deaminase 2 in a polyarteritis nodosa vasculopathy," N. Engl. J. Med. 370(10):921-931 (2014).
Needleman, S. and C. Wunsch, "A general method applicable to the search for similarities in the amino acid sequence of two proteins, A general method applicable to the search for similarities in the amino acid sequence of two proteins," J Mol Biol. 48:443-453 (1970).
Neidzwicki and Aberneth, "Structure-activity relationship of ligands of human plasma adenosine deaminase2," Biochem. Pharmacol. 41(11):1615-1624 (1991).
Newton et al., "Angiogenin single-chain immunofusions: influence of peptide linkers and spacers between fusion protein domains," Biochemistry 35(2):545-553 (1996).
OMIM Entry 607575: Cat eye syndrome chromosome region, candidate 1 (CECR1); retrieved from URL:omim.org/entry/6075757?search=cecr1&highlight=cecr1 [accessed on Jan. 7, 2016] [5 pages].
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
O'Shea et al., "Preferential heterodimer formation by isolated leucine zippers from fos and jun," Science 245(4918):646-648 (1989).
Pages et al., "Effector memory T cells, early metastasis and survival in colorectal cancer," N. Engl. J. Med. 353(25):2654-2666 (2005).
Pardoll, D.M., "The blockade of immune checkpoints in cancer immunotherapy," Nat Rev Cancer 12(4):252-264 (2012).
Parkman et al., "Gene therapy for adenosine deaminase deficiency." Annu. Rev. Med. 51:33-47 (2000).
Pearson, W. and D. Lipman "Improved tools for biological sequence comparison," Proc. Natl. Acad. Sci. USA 85:2444 (1988).
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pinkert et al., "An albumin enhancer located 10 kb upstream functions along with its promoter to direct efficient, liver-specific expression in transgenic mice," Genes and Devel. 1:268-276 (1987).
Prieto et al., "CTLA-4 blockade with ipilimumab: long-term follow-up of 177 patients with metastatic melanoma," Clin Cancer Res 18(7):2039-2047 (2012).
Proudfoot et al., "Glycosaminoglycan binding an oligomerization are essential for the in vivo activity of certain chemokines," Proc. Natl. Acad. Sci. 100(4):1885-1890 (2003).
Quezada et al., "Exploiting CTLA-4, PD-1 and PD-L1 to reactivate the host immune response against cancer," Br J Cancer 108(8):1560-1565 (2013).
Readhead et al., "Expression of a myelin basic protein gene in transgenic shiverer mice: correction of the dysmyelinating phenotype," Cell 48:703-712 (1987).
Reagan-Shaw et al., "Dose translation from animal to human studies revisited," FASEB J. 22(3):659-661 (2008).
Renkvist et al., "A listing of human tumor antigens recognized by T cells," Cancer Imnununol. Immunother. 50(1):1-10 (2001).
Riazi, et al., "The human homolog of insect-derived growth factor, CECR1, is a candidate gene for features of cat eye syndrome," Genomics 64(3):277-285 (2000).
Richmond, T., "Precompiled codon-usage tables," Genome Biology 1:241(2000).
Ridgway et al., "'Knobs-into-holes' engineering of antibody CH3 domains for heavy chain heterodimerization," Protein Engineering, 9(7):617-621 (1996).
Roberts et al., "Chemistry for peptide and protein PEGylation" Advanced Drug Delivery Review 54:459-476 (2002).
Roovers et al., "Efficient inhibition of EGFR signaling and of tumour growth by antagonistic anti-EGFR Nanobodies," Cancer Immunol. Immunother. 56(3):303-317 (2007).
Sadelain, et al., "The promise and potential pitfalls of chimeric antigen receptors," Curr. Opin Immunol. 21(2):215-223 (2009).
Santulli-Marotto et al., "Multivalent RNA aptamers that inhibit CTLA-4 and enhance tumor immunity," Cancer Res. 63(21):7483-7489 (2003).
Sato, H., "Enzymatic procedure for site-specific pegylation of proteins," Adv. Drug Deliv. Rev. 54:487-504 (2002).
Sawhney et al., "Bioerodible hydrogels based on photopolymerized poly(ethylene glycol)-co poly(hydroxyl acid) Diacrylate Macromers," Macromolecules 26:581-587 (1993).
Schellenberger et al., "A recombinant polypeptide extends the in vivo half-life of peptides and proteins in a tunable manner," Nat. Biotechnol. 27(12):1186-1190 (2009).
Schwartz, R. and M. Dayhoff, eds., "Matrices for detecting distant relationships," found in: Atlas of Protein Sequence and Structure, National Biomedical Research Foundation, pp. 353-358 (1979).
Shani, M., "Tissue-specific expression of rat myosin light-chain," Nature 314:283-286 (1985).
Shankaran et al., "IFNgamma and lymphocytes prevent primary tumour development and shape tumour immunogenicity," Nature 410(6832):1107-1111 (2001).
Sharp et al., "Codon usage patterns in *Escherichia coli, Bacillus subtilis, Saccharomyces cerevisiae, Schizosacchammyces pombe, Drosophila melanogaster* and *Homo sapiens*; a review of the considerable within-species diversity," Nucleic Acids Res. 16(17):8207-8211 (1988).
Sharp, P.M. and E. Cowe, "Synonymous codon usage in *Saccharomyces cerevisiae*," Yeast. 7(7):657-678 (1991).
Shimizu Y. and H. Yoshikura, "Multicycle infection of hepatitis C virus in cell culture and inhibition by alpha and beta interferons," J. Virol. 68:8406-8408 (1994).
Sitkovsky, et al., "Physiological control of immune response and inflammatory tissue damage by hypoxia-inducible factors and adenosine A2A receptors," Annu. Rev. Immunol. 22:657-682 (2004).
Smith, D. W. (Ed.), "Computational simulations of biological systems," found in: Biocomputing: Informatics and Genome Projects (pp. 269-306.). New York NY: Academic Press (1993).
Smith, T. and M. Waterman, "Comparison of biosequences," Advances in Applied Mathematics 2:482-489 (1981).
Smyth et al., "NK cells and NKT cells collaborate in host protection from methylcholanthrene-induced fibrosarcoma," Int. Immunol. 13(4):459-463 (2001).

(56) References Cited

OTHER PUBLICATIONS

Snell et al., "T-cell intrinsic effects of GITR and 4-1BB during viral infection and cancer immunotherapy," Immunol. Rev. 244:197-217 (2011).
Stagg and Smyth, "Extracellular adenosine triphosphate and adenosine in cancer," Oncogene 29(39):5346-5358 (2010).
Steinkuhler et al., "Product inhibition of the hepatitis C virus NS3 protease," Biochem. 37:8899-8905 (1998).
Sudo et al., "Establishment of an in vitro assay system for screening hepatitis C virus protease inhibitors using high performance liquid chromatography," Antiviral Res. 32:9-18 (1996).
Swift et al., "Tissue-specific expression of the rat pancreatic elastase I gene in transgenic mice," Cell 38:639-646 (1984).
Takeshita et al., "An enzyme-linked immunosorbent assay for detecting proteolytic activity of hepatitis C virus proteinase," (1997) Anal. Biochem. 247:242-246.
Taliani et al., "A continuous assay of hepatitis C virus protease based on resonance energy transfer depsipeptide substrates," Anal. Biochem. 240:60-67 (1996).
Tammi et al., "Hyaluronan in human tumors: pathobiological and prognostic messages from cell-associated and stromal hyaluronan," Seminar in Cancer Biology 18:288-295 (2008).
Thorpe et al., "New coupling agents for the synthesis of immunotoxins containing a hindered disulfide bond with improved stability in vivo," Cancer Res. 47(22):5924-5931 (1987).
Tripathi, et al., "Adenosine deaminase activity in sera of patients with visceral leishmaniasis in India," Clin. Chim. Acta 388(1-2):135-138 (2008).
Trussel et al., "New strategy for the extention of the serum half-life of antibody fragments," Bioconj. Chem. 20(12):2286-2292 (2009).
Tsubery et al., "Prolonging the action of protein and peptide drugs by a novel approach of reversible polyethylene glycol modification," J Biol. Chem 279(37):38118-38124 (2004).
Turner, R. and R. Tijian,"Leucine repeats and an adjacent DNA binding domain mediate the formation of functional cFos-cJun heterodimers," Science, 243(4899):1689-1694 (1989).
Tyle, P., "Iontophoretic Devices for Drug Delivery," Pharm. Res. 3(6):318-326 (1986).
UniProKB/Swiss-Prot entry Q9NZK5 Retrieved from URL://ibis.internal.epo.org/exam/dbfetch.jsp?id=UNIPROT:Q9NZK5 [accessed on Jan. 28, 2016] [5 pages].
UniProKB/Swiss-Prot entry U6D5W2 Retrieved from URL://ibis.internal.epo.org/exam/dbfetch.jsp?id=UNIPROT:U6D5W2 [accessed on Dec. 23, 2015] [1 page].
UniProKB/Swiss-Prot entry H9ZA29 Retrieved from URL://ibis.internal.epo.org/exam/dbfetch.jsp?id=UNIPROT:H9ZA29 [accessed on Jan. 2, 2016] [1 page].
UniProKB/Swiss-Prot entry H0XC51 Retrieved from URL://ibis.internal.epo.org/exam/dbfetch.jsp?id=UNIPROT:H0XC51 [accessed on Jan. 28, 2016] [1 page].
Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:196-207 (1997).
Vinay et al., "Immunotherapy of cancer with 4-1BB," Mol. Cancer Ther. 11(5):1062-1070 (2012).
Von Hoff et al., "Gemcitabine plus nab-paclitaxel is an active regimen in patients with advanced pancreatic cancer: a phase I/II trial," 29(34):4548-4554 (2011).
Vorobjev et al., "Oligonucleotide conjugated to linear and branched high molecular weight polyethylene glycol as substrates for Rnase H," Nucleosides Nucleotides 18(11-12):2745-2750 (1999).
Wagner et al., "Nucleotide sequence of the thymidine kinase gene of herpes simplex virus type 1," Proc. Natl. Acad. Sci. USA 78:1441-1445 (1981).
Walden et al., "Major histocompatibility complex-restricted and unrestricted activation of helper T cell lines by liposome-bound antigens," J. Mol. Cell Immunol. 2(4):191-197 (1986).
Watson et al., Molecular Biology of the Gene, 4th Edition, The Benjamin/Cummings Pub. co., p. 224 (1987).

Wawrzynczak et al., "Molecular and biological properties of an abrin A chain immunotoxin designed for therapy of human small cell lung cancer," Br. J. Cancer 66(2):361-366 (1992).
Weinberg et al., "Science gone translational: the OX40 agonist story," Immunol Rev 244(1):218-231 (2011).
Whitlow et al., "An improved linker for single-chain Fv with reduced aggregation and enhanced proteolytic stability," Protein Engineering 6:989-995 (1993).
Yamamoto et al., "Identification of a functional promoter in the long terminal repeat of Rous sarcoma virus," Cell 22:787-797 (1980).
Zalipsky, S., "Chemistry of polyethylene glycol conjugates with biologically active molecules," Adv. Drug Del. Rev. 16:157-182 (1995).
Zavialov et al., "Structural basis for the growth factor activity of human adenosine deaminase ADA2," Journal of Biological Chemistry 285(16): 12367-12377 (2010).
Zavialov et al., "Human ADA2 belongs to a new family of growth factors with adenosine deaminase activity," Biochem. J. 391(Pt 1):51-57 (2005).
Zavialov et al., "Human adenosine deaminase 2 induces differentiation of monocytes into macrophages and stimulates proliferation of T helper cells and macrophages," J. Leukoc. Biol. 88(2):279-290 (2010).
Zhao et al., ACS Symposium Series 680:458-472 (1997).
Zhou et al,, "Early-onset stroke and vasculopathy associated with mutations in ADA2," N. Engl. J. Med. 370(10):911-920 (2014).
Rosengren et al., "PEGylated recombinant hyaluronidase PH20 (PEGPH20) enhances checkpoint inhibitor efficacy in syngeneic mouse models of cancer," presented at AACR Annual Meeting, Apr. 20, 2016. New Orleans, LA. Abstract #4886, 1 page.
Stelzer, L., "Platforms for Growth: Building a Premier Oncology Biotech," Presented at theUBS Global Health Care Conference May 24, 2016, 25 pages.
Thanos, C., "Hyaluronan (HA) depletion increases tumor accessibility of T cells and anti-PD-L1 mAb in Hahigh Tumors," AACR Meeting, Apr. 18-22, 2015, Philadelphia, PA. Presentation. 15 pages.
Wang et al., "Enzymatic depletion of adenosine by pegylated, engineered adenosine deaminase 2 (PEG-ADA2): A novel immunotherapeutic approach to treat solid tumors," presented at AACR Annual Meeting, Apr. 18, 2016. New Orleans, LA. Abstract #1472, 1 page.
News Release, Halozyme Therapeutics, Inc., "Halozyme to Present Data from Five Preclinical Studies at American Association of Cancer Research Annual Conference," Published Mar. 17, 2016 [online], Retrieved from: <URL:halozyme.com/investors/news-releases/news-release-details/2016/Halozyme-To-Present-Data-From-Five-Preclinical-Studies-At-American-Association-Of-Cancer-Research-Annual-Conference/default.aspx [retrieved on Mar. 28, 2016], 5 pages.
News Release, Halozyme Therapeutics, Inc., "Halozyme Expands Oncology Pipeline with Two Compounds Designed for Activity in the Tumor Microenvironment," Published Apr. 18, 2016 [online], Retrieved from: <URL:halozyme.com/investors/news-releases/news-release-details/2016/Halozyme-Expands-Oncology-Pipeline-With-Two-Compounds-Designed-For-Activity-In-The-Tumor-Microenvironment/default.aspx#sthash.NmSBwQvE.dpuf [retrieved on Apr. 19, 2016], 6 pages.
Invitation to Provide Information Clarification, dated Jan. 14, 2016, in connection with International Patent Application No. PCT/US2015/055613, 17 pages.
Response, filed Jan. 26, 2016, to Invitation to Provide Information Clarification, dated Jan. 14, 2016, in connection with International Patent Application No. PCT/US2015/055613,27 pages.
Invitation to Pay Additional Fees and Protest Fees, dated Mar. 4, 2016, in connection with International Patent Application No. PCT/US2015/055613, 13 pages.
Response, dated Mar. 31, 2016, to Invitation to Pay Additional Fees and Protest Fees, dated Mar. 4, 2016, in connection with International Patent Application No. PCT/US2015/055613, 2 pages.
International Search Report and Written Opinion, dated May 6, 2016, in connection with International Patent Application No. PCT/U52015/055613, 24 pages.

| | | |
|---|---|---|
| Human | MLVDGPSERPALCFLLLAVAMSFFGSALSIDETRAHLLLKEKMMRLGGRLVLNTKEELAN | 60 |
| Chimpanzee | MLVDGPSERPALCFLLLAVAMSFFGSALSIDETRAHLLLKEKMMRLGGRLVLNTKEELAN | 60 |
| | ************************************************************ | |
| Human | ERLMTLKIAEMKEAMRTLIFPPSMHFFQAKHLIERSQVFNILRMMPKGAALHLHDIGIVT | 120 |
| Chimpanzee | ERLMTLKIAEMKEAMRTLIFPPSMHFFQAKHLIERSQVFNILRMMPKGAALHLHDIGIVT | 120 |
| | ************************************************************ | |
| Human | MDWLVRNVTYRPHCHICFTPRGIMQFRFAHPTPRPSEKCSKWILLEDYRKRVQNVTEFDD | 180 |
| Chimpanzee | MDWLVRNVTYRPHCHICFTPRGIMQFRFAHPTPRTSEKCSKWILLEDYRKRVQNVTEFDD | 180 |
| | *******************************.********************** | |
| Human | SLLRNFTLVTQHPEVIYTNQNVVWSKFETIFFTISGLIHYAPVFRDYVFRSMQEFYEDNV | 240 |
| Chimpanzee | SLLRNFTLVTQHPEVIYTNQNVVWSKFETIFFTISGLIHYAPVFRDYVFRSMQEFYEDNV | 240 |
| | ************************************************************ | |
| Human | LYMEIRARLIPVYELSGEHHDEEWSVKTYQEVAQKFVETHPEFIGIKIIYSDHRSKDVAV | 300 |
| Chimpanzee | LYMEIRARLIPVYELSGEHHDEEWSVKTYQEVAQKFVETHPEFIGIKIIYSDHRSKDVAV | 300 |
| | ************************************************************ | |
| Human | IAESIRMAMGLRIKFPTVVAGFDLVGHEDTGHSLHDYKEALMIPAKDGVKLPYFFHAGET | 360 |
| Chimpanzee | IAESIRTAMGLRTKFPTVVAGFDLVGHEDTGHSLHDYKEALMIPAKVGVKLPYFFHAGET | 360 |
| | ************************************************************ | |
| Human | DWQGTSIDRNILDALMLNTTRIGHGFALSKHPAVRTYSWKDIPIEVCPISNQVLKLVSD | 420 |
| Chimpanzee | DWQGTSIDRNILDALMLNTSRIGHGFALSKHPAVRTYSWKDIPIEVCPISNQVLKLVSD | 420 |
| | ************************************************************ | |
| Human | LRNHPVATLMATGHPMVISSDDPAMFGAKGLSYDFYEVFMGIGGMKADLRTLKQLAMNSI | 480 |
| Chimpanzee | LRNHPVATLMATGHPMVISSDDPAMFGAKGLSYDFYEVFMGIGGMKADLRTLKQLAMNSI | 480 |
| | ************************************************************ | |
| Human | KYSTLLESEKNTFMEIWKKRWDKFIADVATK | 511 |
| Chimpanzee | KYSTLLESEKNTFMEIWKKRWDKFIADVATK | 511 |
| | ****************************** | |

Figure 1A

| | | |
|---|---|---|
| Human | MLVDGPSERPALCFLLLAVAMSFFGSALSIDETRAHLLIEKMMRLGGRLVLNTKEELAN | 60 |
| Gorilla | MLVDGPSERPALRFLLLAVAMSFFGSALSIDETRAHLLIEKMMRLGGRLVLNTKEELAN | 60 |
| | ************* ********************************************* | |
| Human | ERLMTLKIAEMKEAMRTLIFPPSMHFFQAKHLIERSQVFNILRMMPKGAALHLHDIGIVT | 120 |
| Gorilla | ERLMTLKIAEMKEAMRTLIFPPSMHFFQAKHLIERSQVFNVLRMMPKGAALHLHDIGIVT | 120 |
| | *****************************************:************ | |
| Human | MDWLVRNVTYRPHCHICFTPRGIMQFRFAHPTPRPSEKCSKWILLEDYRKRVQNVTEFDD | 180 |
| Gorilla | MDWLVRNVTYRPHCHICFTPRGIMQFRFAHPTPRTSEKCSKWILLEDYRKQVQNVTEFDD | 180 |
| | ********************************:**********:*:******** | |
| Human | SLLRNFTLVTQHPEVIYTNQNVVWSKFETIFFTISGLIHYAPVFRDYVFRSMQEFYEDNV | 240 |
| Gorilla | SLLRNFTLVTQHPEVIYTNQNVVWSKFENIFFTISGLIHYAPVFRDYVFRSMQEFYEDNV | 240 |
| | *************************.***************************** | |
| Human | LYMEIRARLLPVYELSGEHHDEEWSVKTYQEVAQKFVETHPEFIGIKIIYSDHRSKDVAV | 300 |
| Gorilla | LYMEIRARLLPVYELSGEHHDEEWSVKTYQEVAQKFVETHPEFIGIKIIYSDHRSKDVAV | 300 |
| | *********************************************************** | |
| Human | IAESIRMAMGLRIKFPTVVAGFDLVGHEDTGHSLHDYKEALMIPAKDGVKLPYFFHAGET | 360 |
| Gorilla | IAESIRTAMGLRTKFPTVVAGFDLVGHEDTGHSLHDYKEALMIPAKDGVKLPYFFHAGET | 360 |
| | ****:* ********************************************* | |
| Human | DWQGTSIDRNILDALMLNTTRIGHGFALSKHPAVRTYSWKKDIPIEVCPISNQVLKLVSD | 420 |
| Gorilla | DWQGTSIDRNILDALMLNTTRIGHGFALSKHPAVRTYSWKKDIPIEVCPISNQVLKLVSD | 420 |
| | *********************************************************** | |
| Human | LRNHPVATLMATGHPMVISSDDPAMFGAKGLSYDFYEVEMGIGMKADLRTLKQLAMNSI | 480 |
| Gorilla | LRNHPVATLMATGHPMVISSDDPAMFGAKGLSYDFYEVEMGIGMKADLRTLKQLAMNSI | 480 |
| | *********************************************************** | |
| Human | KYSTLLESEKNTFMEIWKKRWDKFIADVATK | 511 |
| Gorilla | KYSTLLESEKNTFMEIWKKRWDKFIADVATK | 511 |
| | ***************************** | |

Figure 1B

| | | |
|---|---|---|
| Human | MLVDGPSERPALCFLLLAVAMSFFGSALSIDETRAHLLLREKMMRLGGRLVLNTKEELAN | 60 |
| Pygmy_chimp | MLVDGPSERPALCFLLLAVAMSFFGSALSIDETRAHLLLREKMMRLGGRLVLNTKEELAN | 60 |
| | ************************************************************ | |
| Human | ERLMTLKIAEMKEAMRTLIFPPSMHFFQAKHLIERSQVFNILRMMPKGAALHLHDIGIVT | 120 |
| Pygmy_chimp | ERLMTLKIAEMKEAMRTLIFPPSMHFFQAKHLIERSQVFNILRMMPKGAALHLHDIGIVT | 120 |
| | ************************************************************ | |
| Human | MDWLVRNVTYRPHCHICFTPRGIMQFRFAHPTPRPSEKCSKWILLEDYRKRVQNVTEFDD | 180 |
| Pygmy_chimp | MDWLVRNVTYRPHCHICFTPRGIMQFRFAHPTPRTSEKCSKWILLEDYRKRVQNVTEFDD | 180 |
| | *******************************:********************** | |
| Human | SLLRNFTLVTQHPEVIYTNQNVVWSKFETIFFTISGLIHYAPVFRDYVERSMQEFYEDNV | 240 |
| Pygmy_chimp | SLLRNFTLVTQHPEVIYTNQNVVWSKFETIFFTISGLIHYAPVFRDYVFRSMQEFYEDNV | 240 |
| | ************************************************************ | |
| Human | LYMEIRARLIPVYELSGEHHDEEWSVKTYQEVAQKFVETHPEFIGIKIIYSDHRSKDVAV | 300 |
| Pygmy_chimp | LYMEIRARLIPVYELSGEHHDEEWSVKTYQEVAQKFVETHPEFIGIKIIYSDHRSKDVAV | 300 |
| | ************************************************************ | |
| Human | IAESIRMAMGLRIKFPTVVAGFDLVGHEDTGHSLHDYKEALMIPAKDGVKLPYFFHAGET | 360 |
| Pygmy_chimp | IAESIRTAMGLRTKFPTVVAGFDLVGHEDTGHSLHDYKEALMIPAKVGVKLPYFFHAGET | 360 |
| | ************************************************************ | |
| Human | DWQGTSIDRNILDALMLNTTRIGHGFALSKHPAVRTYSWKKDIPIEVCPISNQVLKLVSD | 420 |
| Pygmy_chimp | DWQGTSIDRNILDALMLNASRIGHGFALSKHPAVRTYSWEKDIPIEVCPISNQVLKLVSD | 420 |
| | *****************::************* *:******************* | |
| Human | LRNHPVATLMATGHPMVISSDDPAMFGAKGLSYDFYEVFMGIGGMKADLRTLKQLAMNSI | 480 |
| Pygmy_chimp | LRNHPVATLMATGHPMVISSDDPAMFGAKGLSYDFYEVFMGIGGMKADLRTLKQLAMNSI | 480 |
| | ************************************************************ | |
| Human | KYSTLLESEKNTFMEIWKKRWDKFIADVATK | 511 |
| Pygmy_chimp | KYSTLLESEKNTFMEIWKKRWDKFIADVATK | 511 |
| | ****************************** | |

Figure 1C

| | | |
|---|---|---|
| Human | MLVDGPSERPALCFLLLAVAMSFFGSALSIDETRAHLLIKEKMMRLGGRLVLNTKEELAN | 60 |
| Orangutan | MLVDGPSEWPALRFLLLAVAMSFFGSALSIDETRAHLLIKEKMMRLGGRLVLNTKEEQAN | 60 |
| | ******** *** ***************************** ********** **** ** | |
| Human | ERLMTLKIAEMKEAMRTLIFPPSMHFFQAKHLIERSQVFNILRMMPKGAALHLHDIGIVT | 120 |
| Orangutan | ERLMLKIAEMKEAMRTLIFPPSMHFFQAKHLIERSQVFNILRMMPKGAALHLHDIGIVT | 120 |
| | **** ****************************************************** | |
| Human | MDWLVRNVTYRPHCHICFTPRGIMQFRFAHPTPRPSEKCSKWILLEDYRKRVQNVTEFDD | 180 |
| Orangutan | MDWLVRNVTYRPHCHICFTPKGIMQFRFAHPTPRTSEKCSKWILLEDYRKRVQNVTEFDD | 180 |
| | ******************** *************: ************************ | |
| Human | SLLRNFTLVTQHPEVIYTNQNVVWSKFETIFFTISGLIHYAPVFRDYVFRSMQEFYEDNV | 240 |
| Orangutan | SLLRNFTLVTQHPEVIYTNQNVVWSKFETIFFTISGLIHYAPVFRDYVFQSMQEFYEDNV | 240 |
| | **********************************************:******** | |
| Human | LYMEIRARLLPVYELSGEHHDEEWSVKTYQEVAQKFVETHPEFIGIKIIYSDHRSKDVAV | 300 |
| Orangutan | LYMEIRARLLPVYELSGEHHDEEWSVKTYQEVAQKFVETHPEFIGIKIIYSDHRSKDVAV | 300 |
| | ************************************************************ | |
| Human | IAESIRMAMGLRIKFPTVVAGFDLVGHEDTGHSLHDYKEALMIPAKDGVKLPYFFHAGET | 360 |
| Orangutan | IAESIRTAMGLRTKFPTVVAGFDLVGREDTGHSLQDYKEALMIPAKGGVKLPYFFHAGET | 360 |
| | ****** ***** *********** ******* ********** ************* | |
| Human | DWQGTSIDRNILDALMLNTTRIGHGFALSKHPAVRTYSWKKDIPIEVCPISNQVLKLVSD | 420 |
| Orangutan | DWQGTSIDRNILDALMLNTTRIGHGFALSKHPAVRAYSWKKDIPIEVCPISNQVLKLVSD | 420 |
| | ******************************** *:*******************  | |
| Human | LRNHPVATLMATGHPMVISSDDPAMFGAKGLSYDFYEVFMGIGGMKADLRTLKQLAMNSI | 480 |
| Orangutan | LRNHPVATLMATGHPMVISSDDPAIFGAKGLSYDFYEVFMGIGGMKADLRTLKQLAMNSI | 480 |
| | ************************ ********************************** | |
| Human | KYSTLLESEKNTFMEIWKKRWDKFIADVATK | 511 |
| Orangutan | KYSALLEIEKNTFMEIWKKRWDKFIADVATK | 511 |
| | * ***  :**** ********************* | |

Figure 1D

```
Human   MLVDGPSERPALCFLLLAVAMSFFGSALSIDETRAHLLLKEKMMRLGGRLVLNTKEELAN   60
Gibbon  MLVDGPSEWPALRFLLLAVAMSFFGSALSIDETRAHLLLREKMMRLGGRLVLSTKEEQAN   60
        *******. *** .********************** . ************..****:*:

Human   ERLMTLKIAEMKEAMRTLIFPPSMHFFQAKHLIERSQVFNLLRMMPKGAALHLHDIGIVT  120
Gibbon  ERLMTLKITEMKEAMKTLIFPPSMHFFQAKHLIERSQVFNLLRMMPKGAALHLHDIGIVT  120
        ********:******:********************************************

Human   MDWLVRNVTYRPHCHICFTPRGIMQFRFAHPTPRPSEKCSKWILLEDYRKRVQNVTEFDD  180
Gibbon  MDWLVRNVTYRPHCHICFTPKGIMQFRFAHPTPRTSEKCSKWILLEDYRKRVQNVTEFDD  180
        ********************:*************:.**********************

Human   SLLRNFTLVTQHPEVIYTNQNVVWSKFETIFFTISGLIHYAPVFRDYVFRSMQEFYEDNV  240
Gibbon  SLLRNFTLVTQHPEVIYTNQNVVWSKFETIFFTISGLIHYAPVFRDYVFX------DNV  233
        ***********************************************. ***

Human   LYMEIRARLLPVYELSGEHHDEEWSVKTYQEVAQKFVETHPEFIGIKIIYSDHRSKDVAV  300
Gibbon  LYMEIRARLLPVYELSGEHHDEEWSVKTYQEVAQKFVETHPEFIGIKIIYSDHRSKDVAV  293
        ************************************************************

Human   IAESIRMAMGLRIKFPTVVAGFDLVGHEDTGHSLHDYKEALMIPAKDGVKLPYFFHAGET  360
Gibbon  IAESIRTAMGLRAKFPTVVAGFDLVGHEDTGHSLHDYKEALMIPTKDGVKLPYFFHAGET  353
        ******:***** *******************************:***************

Human   DWQGTSIDRNILDALMLNTTRIGHGFALSKHPAVRTYSWKKDIPIEVCPISNQVLKLVSD  420
Gibbon  DWQGTSIDKNILDALMLNTTRIGHGFALSKHPAVRAYSWKKDIPIEVCPISNQVLKLVSD  413
        ********:**************************:*************************

Human   LRNHPVATLMATGHPMVISSDDPAMFGAKGLSYDFYEVFMGIGGMKADLRTLKQLAMNSI  480
Gibbon  LRNHPVATLMATGHPMVISSDDPAIFGAKGLSYDFYEVFMGIGGMKADLRTLKQLAMNSI  473
        ***********************:************************************

Human   KYSTLLESEKNTFMEIWKKRWDKFIADVATK  511
Gibbon  KYSTLLETEKNTFMEIWKKRWDKFIADVATK  504
        *******:***********************
```

Figure 1E

| | | |
|---|---|---|
| Human | MLVDGPSERPALCFLLLAVAMSFFGSALSIDETRAHLLIKEKMMRLIGGRLVLNTKEELAN | 60 |
| Macaque | MLVDGPSEWPALRFLLLAVAMSFFRSALSIDE---AHLLIEKMMRLIGGELVLTTKEEQAN | 58 |
| | ******:*:***********:**   *******.*:**. | |
| Human | ERLMTLKIAEMKEAMRTLIEFPPSMHFFQAKHLIERSQVFNILRMMPKGAALHLHDIGIVT | 120 |
| Macaque | ERLMTLKIAEMKEAMKTLIEFPPSMHFFQAKHLIERSQVFNILRMMPKGAALHLHDTGIVT | 118 |
| | *************:***************************************:** | |
| Human | MDWLVRNVTYRPHCHICFTPRGIMQFRFAHPTPRPSEKCSKWILLEDYRKRVQNVTEFDD | 180 |
| Macaque | MDWLVRNVTYRPHCHICFTSKGIMQFRFAHPTPRTSEKCSKWILLEDYRKRVQNVTEFDD | 178 |
| | *****************:.*********:********************** | |
| Human | SLLRNFTLVTQHPEVIYTNQNVVWSKFETIFFTISGLIHYAPVFRDYVFRSMQEFYEDNV | 240 |
| Macaque | SLLRNFTLVTQHPEVIYTNQNVVWSKFQTIFFTISGLIRYAPVFRDYVFRSMQEFYEDNV | 238 |
| | *************************:*****:******************* | |
| Human | LYMEIRARLLEPVYELSGEHHDEEWSVKTYQEVAQKFVETHPEFIGIKIIYSDHRSKDVAV | 300 |
| Macaque | LYMEIRARLIEPVYELSGEHHDEEWSVKTYQEVAQKFVETHPEFIGIKIIYSDDRSKDVTV | 298 |
| | *******:************************************:***:* | |
| Human | IAESIRMAMGLRIKFPTVVAGFDLVGHEDTGHSLHDYKEALMIPAKDGVKLPYFFHAGET | 360 |
| Macaque | IAESIRTAMGLRTKFPTVVAGFDLVGHEDTGHSLHYYKEALMIPARDGGKLPYFFHAGET | 358 |
| | ****:* *****************:***:.*********** | |
| Human | DWQGTSIDRNILDALMLNTTRIGHGFALSKHPAVRTYSWKKDIPIEVCPISNQVLKLVSD | 420 |
| Macaque | DWQGTSIDKNILDALMLNTTRIGHGFALSKHPAARAYSWEKDIPIEVCPISNQVLKLVSD | 418 |
| | ******:*********************:*:*:****************** | |
| Human | LRNHPVATLMATGHPMVISSDDPAMFGAKGLSYDFYEVFMGIGGMKADLRTLKQLAMNSI | 480 |
| Macaque | LRNHPVAALMAIGHPMVISSDDPAMFGAKGLSYDFYEAFMGIGGMKADLRTLKQLAMNSI | 478 |
| | *****:* ***********************.******************* | |
| Human | KYSTLLESEKNTFMEIWKKRWDKFIADVATK | 511 |
| Macaque | RYSTLLETEKNTFMEIWKKRWDKFIADVATK | 509 |
| | :****:******************** | |

Figure 1F

COMPOSITIONS OF ADENOSINE DEAMINASE-2 (ADA2), VARIANTS THEREOF AND METHODS OF USING SAME

RELATED APPLICATIONS

This application is a continuation-in-part of International PCT application No. PCT/US15/55613, filed Oct. 14, 2015, to Applicant Halozyme, Inc. and inventors Christopher D. Thanos, Lin Wang and H. Michael Shepard, entitled COMPOSITIONS OF ADENOSINE DEAMINASE-2 (ADA2), VARIANTS THEREOF AND METHODS OF USING SAME, which claims the benefit of priority to U.S. provisional application Ser. No. 62/063,936, filed Oct. 14, 2014, to inventors Christopher D Thanos, Lin Wang and H. Michael Shepard, entitled COMPOSITIONS OF ADENOSINE DEAMINASE-2 (ADA2), VARIANTS THEREOF AND METHODS OF USING SAME. The subject matter of these applications is incorporated by reference in its entirety.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Apr. 8, 2016, is 3,177 kilobytes in size, and titled 3121SEQ001.txt. A substitute Sequence Listing is filed electronically herewith, the contents of which are incorporated by reference in their entirety. The electronic file was created on Jun. 2, 2016, is identical, 3,177 kilobytes in size, and titled 3121SEQ.002.txt.

FIELD OF THE INVENTION

Provided are variant adenosine deaminase 2 (ADA2) proteins. Also provided are ADA2 conjugates and compositions containing an ADA2 protein or ADA2 conjugate. Also provided are methods and uses of the ADA2 proteins or conjugates for treating diseases and conditions, such as a tumor or cancer, and in particular any disease or condition associated with elevated adenosine or other associated marker.

BACKGROUND

Adenosine is a well-known effector of immune function. In T-cells, adenosine decreases T-cell receptor induced activation of NF-κB, and inhibits IL-2, IL-4, and IFN-γ. Adenosine decreases T-cell cytotoxicity, increases T-cell anergy, and increases T-cell differentiation to Fop3+ or Lag-3+ regulatory (T-reg) T-cells. On NK cells, adenosine is known to decrease IFN-γ production, and suppress NK cell cytoxicity. Adenosine is known to block neutrophil adhesion and extravasation, decrease phagocytosis, and attenuate levels of superoxide and nitric oxide. Adenosine also decreases the expression of TNF-α, IL-12, and MIP-1α on macrophages, attenuates MHC Class II expression, and increases levels of IL-10 and IL-6. In addition, adenosine decreases phagocytosis and superoxide and nitric oxide levels on macrophages. Through these immune-related activities, and others, aberrant or accumulated levels of adenosine is associated with a number of diseases and conditions, including those in which the adenosine-mediated immunosuppressive effects play a role. Hence, there is a need for treatments of such diseases and conditions.

SUMMARY

Provided herein are variant Adenosine Deaminase 2 (ADA2) proteins or catalytically active portions thereof that contain a modification(s) in the sequence of amino acids of an unmodified ADA2 protein or a catalytically active portion thereof. In some embodiments, the unmodified ADA2 protein can include the sequence of amino acids set forth in SEQ ID NO:5, or a sequence of amino acids that can exhibit at least 85% sequence identity to the sequence of amino acids set forth in SEQ ID NO:5, or is a catalytically active portion thereof; the amino acid modification(s) are selected from among amino acid replacement(s), deletion(s) and insertion(s); and the variant ADA2, when in dimer form, can exhibit one or more properties selected from among increased adenosine deaminase activity, reduced heparin binding, longer serum half-life, altered pH optimum, increased thermal stability, altered receptor binding and hyperglycosylation compared to the corresponding dimer form of the unmodified ADA2 protein. A variety of amino acid modifications, including replacements, deletions and insertions are provided. It is understood that the discreet modifications that confer a particular activity or property can be combined; as in proteins effects of mutation or modifications generally are additive. Any of the variant ADA2 or catalytically active portion thereof provided herein that contains modifications, including replacements, deletions and insertions, and nucleic acids encoding the variant ADA2 or catalytically active portion thereof, can be used in any of the methods, compositions, conjugates, modified forms, vectors, cells, combinations, uses and compositions for use, and combinations for use, provided herein.

In some embodiments, the variant ADA2 protein or catalytically active portion thereof, when in dimer form, exhibits increased adenosine deaminase activity or increased adenosine deaminase activity and reduced heparin binding.

In some embodiments, the unmodified ADA2 protein is a homodimer, and the monomer form comprises the sequence of amino acid residues set forth in SEQ ID NO:5. In some embodiments, the variant ADA2 is a catalytically active portion of the variant ADA2 protein as provided herein, wherein the unmodified ADA2 protein is a homodimer of corresponding catalytically active portions of the polypeptide whose sequence is set forth in of SEQ ID NO:5, wherein corresponding portions are determined by alignment.

In some embodiment, the ADA2 protein or catalytically active portion thereof does not contain a modification selected from among an amino acid replacement corresponding to H7R, G18A, G18R, G18V, I64T, A80D, H83Q, V90A, C108G, A120V, H121R, W133G, R125C, R140Q, K141R, R142W, P164L, P222L, W235S, H306R, E330G, W333G, V365L, Y424C, F464S or a deletion corresponding to R8-K14del→--, with numbering with reference to amino acid residues set forth in SEQ ID NO:5.

In some embodiments, the unmodified ADA2 protein can include a sequence of amino acids that has at least 85%, 86%, 87%, 88%, 89%, 90%, 91%, 92%, 93%, 94%, 95%, 96%, 97%, 98%, 99% or more sequence identity to the sequence of amino acids set forth in SEQ ID NO:5 or is a catalytically active portion thereof. For example, the unmodified ADA2 protein has at least 95% sequence identity with the sequence of amino acids set forth in SEQ ID NO:5 or with the corresponding catalytically active portion thereof. For example, the unmodified ADA2 protein includes the sequence of amino acids set forth in any of SEQ ID NOS:5, 326-334, 340, 375 or 380-383 or is a catalytically active portion thereof, or the unmodified ADA2 protein has a sequence of amino acids set forth in any of SEQ ID NOS:5, 326-334, 340, 375 and 380-383 or is a catalytically active portion thereof. In particular embodiments, the unmodified ADA2 protein includes the sequence of amino acids set forth in SEQ ID NO:5 or is a catalytically active portion thereof.

In some embodiments, the catalytically active portion of the ADA2 protein can be an ADA2 protein that lacks all or a portion of the putative receptor binding (PRB) domain. For example, the catalytically active portion of the ADA2 protein can include the sequence of amino acids set forth in SEQ ID NOS:548-550. In some embodiments, the catalytically active portion of the unmodified ADA2 protein has the sequence set forth as residues 77-473 of the protein set forth in SEQ ID NO:5.

In some embodiments, the variant ADA2 protein can include up to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid modifications compared to the unmodified ADA2 protein. In some embodiments the variant ADA2 protein includes up to 2, 3, 4, 5, 6, 7, 8, 9 or 10 amino acid modifications. In some embodiments, the variant ADA2 protein does not contain the sequence of amino acids set forth in any of SEQ ID NOS: 1, 5, 68, 286-302, 326-342 or 374-383 or catalytically active fragment thereof. In some embodiments, the primary amino acid sequence of the ADA2 protein variant is not the sequence of amino acids set forth in any of SEQ ID NOS: 1, 5, 68, 286-302, 326-342 or 374-383.

In some embodiments, the variant ADA2 protein, when in dimer form, exhibits adenosine deaminase activity to convert adenosine to inosine. In some embodiments herein, the variant ADA2 protein, when in dimer form, can exhibit a catalytic efficiency ($k_{cat}/K_M$) that is at least or at least about $5 \times 10^3$ M$^{-1}$ s$^{-1}$, $6 \times 10^3$ M$^{-1}$ s$^{-1}$, $7 \times 10^3$ M$^{-1}$ s$^{-1}$, $8 \times 10^3$ M$^{-1}$ s$^{-1}$, $9 \times 10^3$ M$^{-1}$ s$^{-1}$, $1 \times 10^4$ M$^{-1}$ s$^{-1}$, $2 \times 10^4$ M$^{-1}$ s$^{-1}$, $3 \times 10^4$ M$^{-1}$ s$^{-1}$, $4 \times 10^4$ M$^{-1}$ s$^{-1}$, $5 \times 10^4$ M$^{-1}$ s$^{-1}$, $6 \times 10^4$ M$^{-1}$ s$^{-1}$, $7 \times 10^4$ M$^{-1}$ s$^{-1}$, $8 \times 10^4$ M$^{-1}$ s$^{-1}$, $9 \times 10^4$ M$^{-1}$ s$^{-1}$, $1 \times 10^5$ M$^{-1}$ s$^{-1}$, $2 \times 10^5$ M$^{-1}$ s$^{-1}$, $3 \times 10^5$ M$^{-1}$ s$^{-1}$, $4 \times 10^5$ M$^{-1}$ s$^{-1}$, $5 \times 10^5$ M$^{-1}$ s$^{-1}$ or greater.

In some embodiments, the variant ADA2 protein, when in dimer form, can exhibit a thermal stability with a melting temperature (Tm) of at least 58° C. For example, the Tm of the ADA2 protein is at least 59° C., 60° C., 61° C., 62° C., 63° C., 64° C., 65° C., 66° C., 68° C., 69° C., 70° C., 71° C., 72° C. or greater.

In some embodiments, the variant ADA2 protein can contain a modification(s) that is an amino acid replacement(s); and the variant ADA2 protein includes one or more amino acid replacement(s) at an amino acid position corresponding to amino acid residue 11, 13, 20, 22, 26, 86, 179, 217, 219, 221, 258, 262, 264, 266, 267, 277, 283, 296, 309, 317, 321, 352, 366, 371, 372, 373, 374, 403, 404, 405, 406, 441, 444, 452, 461, 469 or 470, with reference to amino acid positions set forth in SEQ ID NO:5. For example, the amino acid replacement(s) are positions corresponding to amino acid residue 11, 20, 219, 221, 262, 264, 366, 371, 372 or 452, with reference to amino acid positions set forth in SEQ ID NO:5. In some embodiments, the variant ADA2 protein can include one or more amino acid replacement(s) selected from among K11A, K11D, K11E, K13A, K13D, K13E, R20A, R20D, R20E, R20N, V22S, K26A, K26D, K26E, D86A, D86C, D86E, D86F, D86G, D86H, D86I, D86K, D86L, D86M, D86N, D86P, D86Q, D86R, D86S, D86T, D86V, D86W, D86Y, E179A, E179C, E179D, E179F, E179G, E179H, E179I, E179K, E179L, E179M, E179N, E179P, E179Q, E179R, E179S, E179T, E179V, E179W, E179Y, R217A, R217D, R217E, R219A, R219C, R219D, R219E, R219F, R219G, R219H, R219I, R219K, R219L, R219M, R219N, R219P, R219Q, R219S, R219T, R219V, R219W, R219Y, L221A, L221C, L221D, L221E, L221F, L221G, L221H, L221I, L221K, L221M, L221N, L221P, L221Q, L221R, L221S, L221T, L221V, L221W, L221Y, K258A, K258D, K258E, S262A, S262C, S262D, S262E, S262F, S262G, S262H, S262I, S262K, S262L, S262M, S262N, S262P, S262Q, S262R, S262T, S262V, S262W, S262Y, H264A, H264C, H264D, H264E, H264F, H264G, H264I, H264K, H264L, H264M, H264N, H264P, H264Q, H264R, H264S, H264T, H264V, H264W, H264Y, S266A, S266C, S266D, S266E, S266F, S266G, S266H, S266I, S266K, S266L, S266M, S266N, S266P, S266Q, S266R, S266T, S266V, S266W, S266Y, K267A, K267C, K267D, K267E, K267F, K267G, K267H, K267I, K267L, K267M, K267N, K267P, K267Q, K267R, K267S, K267T, K267V, K267W, K267Y, R277A, R277D, R277E, R283A, R283D, R283E, V296A, V296C, V296D, V296E, V296F, V296G, V296H, V296I, V296K, V296L, V296M, V296N, V296P, V296Q, V296R, V296S, V296T, V296W, V296Y, K309A, K309D, K309E, K317A, K317D, K317E, K321A, K321D, K321E, K352A, K352D, K352E, R366A, R366D, R366E, K371A, K371D, K371E, K371N, K372A, K372D, K372E, K372N, D373S, I374S, T403N, G404N, H405S, P406S, R441A, R441D, R441E, K444A, K444D, K444E, K452A, K452D, K452E, K461A, K461D, K461E, K469A, K469D, K469E, K470A, K470D, and K470E, with reference to amino acid positions set forth in SEQ ID NO:5. For example, the variant ADA2 protein contains one or more amino acid replacement(s) selected from among replacements corresponding to H264A; H264Q; H264N; H264G; R219K; R219Q; R219N; R219A; L221A; L221V; L221G; E179D; E179A; E179S; E179T; E179V; E179G; S262A; S262V; S262M; S262N; D86A; D86C; D86E; D86F; D86G; D86H; D86I; D86K; D86L; D86M; D86N; D86P; D86Q; D86R; D86S; D86T; D86V; D86W; D86Y; E179C; E179F; E179H; E179I; E179K; E179L; E179M; E179N; E179P; E179Q; E179R; E179W; E179Y; R219C; R219D; R219E; R219F; R219G; R219H; R219I; R219L; R219M; R219P; R219S; R219T; R219V; R219W; R219Y; L221C; L221D; L221E; L221F; L221H; L221I; L221K; L221M; L221N; L221P; L221Q; L221R; L221S; L221T; L221W; L221Y; S262C; S262D; S262E; S262F; S262G; S262H; S262I; S262K; S262L; S262P; S262Q; S262R; S262T; S262W; S262Y; H264C; H264D; H264E; H264F; H264I; H264K; H264L; H264M; H264P; H264R; H264S; H264T; H264V; H264W; H264Y; S266A; S266C; S266D; S266E; S266F; S266G; S266H; S266I; S266K; S266L; S266M; S266N; S266P; S266Q; S266R; S266T; S266V; S266W; S266Y; K267A; K267C; K267D; K267E; K267F; K267G; K267H; K267I; K267L; K267M; K267N; K267P; K267Q; K267R; K267S; K267T; K267V; K267W; K267Y; V296A; V296C; V296D; V296E; V296F; V296G; V296H; V296I; V296K; V296L; V296M; V296N; V296P; V296Q; V296R; V296S; V296T; V296W; and V296Y.

In some embodiments, the variant ADA2 protein contains an amino acid replacement at one or both of positions corresponding to amino acid residue 219 and 262, with reference to amino acid positions set forth in SEQ ID NO:5. For Example, the variant ADA2 protein or catalytically active portion thereof contains the replacement corresponding to S262N or S262Q. In some embodiments, the variant ADA2 contains the replacement corresponding to S262N. In some embodiments, the variant ADA2 contains the replacement corresponding to R219K, R219Q, R219N or R219A.

In other embodiments, the variant ADA2 contains the replacement corresponding to R219Q or the replacements R219Q/R20E. In other embodiments, the variant ADA2 contains the replacement corresponding to R219Q/S262N. For example, the variant ADA2 protein or catalytically active portion thereof contains modification(s) selected from among any of R219Q/S262N/---→N1/---→A2/---→S3, R219Q/S262N/R20N/V22S, R219Q/S262N/K371N/D373S, R219Q/S262N/K372N/I374S, R219Q/S262N/T403N/H405S, R219Q/S262N/G404N/P406S, R219Q/S262N/C105-T147del→(Gly)$_{15}$, R219Q/S262N/C105-T147del→(Gly)$_{10}$, R219Q/S262N/C105-T147del→(Gly)$_{7}$, R219Q/S262N/C105-T147del→(Gly)$_{5}$, R219Q/S262N/C105-T147del→(Gly)$_{3}$, R219Q/S262N/R125N/P126A, R219Q/S262N/S127N/K129S, R219Q/S262N/P126N/E128T, R219Q/S262N/R112N/I114T, R219Q/S262N/I134N/L135C/L136T, R219Q/S262N/I134N/L135S/L136T, R219Q/S262N/R142N/Q144S, R219Q/S262N/E137N/Y139T, R219Q/S262N/P111N/G113S, R219Q/S262N/F119S, R219Q/S262N/F119K, R219Q/S262N/Y224R, R219Q/S262N/Y224N, R219Q/S262N/Y191S, R219Q/S262N/Y191D, R219Q/S262N/F183K, R219Q/S262N/Y191D/Y224R, R219Q/S262N/F109S, R219Q/S262N/F109A, R219Q/S262N/R118D, R219Q/S262N/R118A, R219Q/S262N/Y139T, R219Q/S262N/Y139A, R219Q/S262N/W133S, R219Q/S262N/W133T, R219Q/S262N/P124A, R219Q/S262N/P124S, R219Q/S262N/V99-Q144del→(GGGGS)$_{1}$, R219Q/S262N/V99-Q144del→(GGGGS)$_{2}$, R219Q/S262N/V99-Q144del→(GGGGS)$_{3}$, R219Q/S262N/C105-T147del→(GGGGS)$_{1}$, R219Q/S262N/C105-T147del→(GGGGS)$_{2}$, R219Q/S262N/C105-T147del→(GGGGS)$_{3}$, R219Q/S262N/K371D/V99-Q144del→(GGGGS)$_{1}$, R219Q/S262N/K371D/V99-Q144del→(GGGGS)$_{2}$, R219Q/S262N/K371D/V99-Q144del→(GGGGS)$_{3}$, R219Q/S262N/K371D/C105-T147del→(GGGGS)$_{1}$, R219Q/S262N/K371D/C105-T147del→(GGGGS)$_{2}$, R219Q/S262N/K371D/C105-T147del→(GGGGS)$_{3}$, R219Q/S262N/C105-T147del→(Gly)n, R219Q/S262N/K11A, R219Q/S262N/K11D, R219Q/S262N/K11E, R219Q/S262N/K13A, R219Q/S262N/K13D, R219Q/S262N/V99-Q144del→(GGGGS)n, R219Q/S262N/C105-T147del→(GGGGS)n, R219Q/S262N/N98-N156del, R219Q/S262N/C105-E148del, R219Q/S262N/C105-T147del, R219Q/S262N/V99-Q144del, R219Q/S262N/K371D/C105-T147del→(Gly)n, R219Q/S262N/K371D/C105-T147del→(Gly)$_{15}$, R219Q/S262N/K371D/C105-T147del→(Gly)$_{10}$, R219Q/S262N/K371D/C105-T147del→(Gly)$_{7}$, R219Q/S262N/K371D/C105-T147del→(Gly)$_{5}$, R219Q/S262N/K371D/C105-T147del→(Gly)$_{3}$, R219Q/S262N/K371D/V99-Q144del→(GGGGS)n, R219Q/S262N/K371D/C105-T147del→(GGGGS)n, R219Q/S262N/K371D/N98-N156del, R219Q/S262N/K371D/C105-E148del, R219Q/S262N/K371D/C105-T147del, R219Q/S262N/K371D/V99-Q144del, R219Q/S262N/K13E, R219Q/S262N/K371A, R219Q/S262N/K372A, R219Q/S262N/K372D, R219Q/S262N/K372E, R219Q/S262N/K452A, R219Q/S262N/K452D, R219Q/S262N/K452E, R219Q/S262N/R20A, R219Q/S262N/R20D, R219Q/S262N/R366A, R219Q/S262N/R366D, R219Q/S262N/R366E, R219Q/S262N/H264A, R219Q/S262N/H264Q, R219Q/S262N/H264N, R219Q/S262N/H264G, R219K/S262N, R219N/S262N, R219A/S262N, R219Q/S262N/L221A, R219Q/S262N/L221V, R219Q/S262N/L221G, R219Q/S262N/E179D, R219Q/S262N/E179A, R219Q/S262N/E179S, R219Q/S262N/E179T, R219Q/S262N/E179V, R219Q/S262N/E179G, R219Q/S262A, R219Q/S262V, R219Q/S262M, R219Q/S262N/K11A/R20A, R219Q/S262N/K11A/R20A/K371A, R219Q/S262N/R20A/K371A, R219Q/S262N/K11A/K371A, R219Q/S262N/K26A, R219Q/S262N/K26D, R219Q/S262N/K26E, R219Q/S262N/R217A, R219Q/S262N/R217D, R219Q/S262N/R217E, R219Q/S262N/K258A, R219Q/S262N/K258D, R219Q/S262N/K258E, R219Q/S262N/R277A, R219Q/S262N/R277D, R219Q/S262N/R277E, R219Q/S262N/R283A, R219Q/S262N/R283D, R219Q/S262N/R283E, R219Q/S262N/K309A, R219Q/S262N/K309D, R219Q/S262N/K309E, R219Q/S262N/K317A, R219Q/S262N/K317D, R219Q/S262N/K317E, R219Q/S262N/K321A, R219Q/S262N/K321D, R219Q/S262N/K321E, R219Q/S262N/R352A, R219Q/S262N/R352D, R219Q/S262N/R352E, R219Q/S262N/R441A, R219Q/S262N/R441D, R219Q/S262N/R441E, R219Q/S262N/K444A, R219Q/S262N/K444D, R219Q/S262N/K444E, R219Q/S262N/K461A, R219Q/S262N/K461D, R219Q/S262N/K461E, R219Q/S262N/K469A, R219Q/S262N/K469D, R219Q/S262N/K469E, R219Q/S262N/K470A, R219Q/S262N/K470D, R219Q/S262N/K470E, R219Q/S262N/D86A, R219Q/S262N/D86C, R219Q/S262N/D86E, R219Q/S262N/D86F, R219Q/S262N/D86G, R219Q/S262N/D86H, R219Q/S262N/D86I, R219Q/S262N/D86K, R219Q/S262N/D86L, R219Q/S262N/D86M, R219Q/S262N/D86N, R219Q/S262N/D86P, R219Q/S262N/D86Q, R219Q/S262N/D86R, R219Q/S262N/D86S, R219Q/S262N/D86T, R219Q/S262N/D86V, R219Q/S262N/D86W, R219Q/S262N/D86Y, R219Q/S262N/E179C, R219Q/S262N/E179F, R219Q/S262N/E179H, R219Q/S262N/E179I, R219Q/S262N/E179K, R219Q/S262N/E179L, R219Q/S262N/E179M, R219Q/S262N/E179N, R219Q/S262N/E179P, R219Q/S262N/E179Q, R219Q/S262N/E179R, R219Q/S262N/E179W, R219Q/S262N/E179Y, R219C/S262N, R219D/S262N, R219E/S262N, R219F/S262N, R219G/S262N, R219H/S262N, R219I/S262N, R219L/S262N, R219M/S262N, R219P/S262N, R219S/S262N, R219T/S262N, R219V/S262N, R219W/S262N, R219Y/S262N, R219Q/S262N/L221C, R219Q/S262N/L221D, R219Q/S262N/L221E, R219Q/S262N/L221F, R219Q/S262N/L221H, R219Q/S262N/L221I, R219Q/S262N/L221K, R219Q/S262N/L221M, R219Q/S262N/L221N, R219Q/S262N/L221P, R219Q/S262N/L221Q, R219Q/S262N/L221R, R219Q/S262N/L221S, R219Q/S262N/L221T, R219Q/S262N/L221W, R219Q/S262N/L221Y, R219Q/S262C, R219Q/S262D, R219Q/S262E, R219Q/S262F, R219Q/S262G, R219Q/S262H, R219Q/S262I, R219Q/S262K, R219Q/S262L, R219Q/S262P, R219Q/S262Q, R219Q/S262R, R219Q/S262T, R219Q/S262W, R219Q/S262Y, R219Q/S262N/H264C, R219Q/S262N/H264D, R219Q/S262N/H264E, R219Q/S262N/H264F, R219Q/S262N/H264I, R219Q/S262N/H264K, R219Q/S262N/H264L, R219Q/S262N/H264M, R219Q/S262N/H264P, R219Q/S262N/H264R, R219Q/S262N/H264S, R219Q/S262N/H264T, R219Q/S262N/H264V, R219Q/S262N/H264W, R219Q/S262N/H264Y, R219Q/S262N/S266A, R219Q/S262N/S266C, R219Q/S262N/S266D, R219Q/S262N/S266E, R219Q/S262N/S266F, R219Q/S262N/S266G, R219Q/S262N/S266H, R219Q/S262N/S266I, R219Q/S262N/S266K, R219Q/S262N/S266L, R219Q/S262N/S266M, R219Q/S262N/S266N, R219Q/S262N/S266P, R219Q/S262N/S266Q, R219Q/S262N/S266R, R219Q/S262N/S266T, R219Q/S262N/S266V, R219Q/S262N/S266W, R219Q/S262N/S266Y, R219Q/S262N/K267A, R219Q/S262N/K267C, R219Q/S262N/K267D, R219Q/S262N/K267E, R219Q/S262N/K267F, R219Q/S262N/K267G, R219Q/S262N/K267H, R219Q/S262N/K267I, R219Q/

S262N/K267L, R219Q/S262N/K267M, R219Q/S262N/ K267N, R219Q/S262N/K267P, R219Q/S262N/K267Q, R219Q/S262N/K267R, R219Q/S262N/K267S, R219Q/ S262N/K267T, R219Q/S262N/K267V, R219Q/S262N/ K267W, R219Q/S262N/K267Y, R219Q/S262N/V296A, R219Q/S262N/V296C, R219Q/S262N/V296D, R219Q/ S262N/V296E, R219Q/S262N/V296F, R219Q/S262N/ V296G, R219Q/S262N/V296H, R219Q/S262N/V296I, R219Q/S262N/V296K, R219Q/S262N/V296L, R219Q/ S262N/V296M, R219Q/S262N/V296N, R219Q/S262N/ V296P, R219Q/S262N/V296Q, R219Q/S262N/V296R, R219Q/S262N/V296S, R219Q/S262N/V296T, R219Q/ S262N/V296W and R219Q/S262N/V296Y. In some embodiments, the variant ADA2 protein comprises the modifications selected from among R219Q/K11A/R20A, R219Q/K11A/R20A/K371A, R219Q/R20A/K371A, 219Q/ K11A/K371A, S262N/K11A/R20A, S262N/K11A/R20A/ K371A, S262N/R20A/K371A, S262N/K11A/K371A, R219Q/C105-T147del→(Gly)n, R219Q/V99-Q144del→ (GGGGS)n, R219Q/C105-T147del→(GGGGS)n, R219Q/ N98-N156del, R219Q/C105-E148del, R219Q/C105-T147del, R219Q/V99-Q144del, S262N/C105-T147del→ (Gly)n, S262N/V99-Q144del→(GGGGS)n, S262N/C105-T147del→(GGGGS)n, S262N/N98-N156del, S262N/C105-E148del, S262N/C105-T147del and S262N/V99-Q144del.

In some embodiments, the variant ADA2 protein, when in dimer form, can exhibit increased adenosine deaminase activity. For example, the variant ADA2 protein, when in dimer form, can exhibit at least 110%, 120%, 130%, 140%, 150%, 160%, 170%, 180%, 190%, 200%, 225%, 250%, 300%, 350%, 400%, 450%, 500%, 600%, 700%, 800% or more activity of the corresponding dimer form of the unmodified ADA2 protein, wherein adenosine deaminase activity is assessed under the same conditions. In some embodiments, the variant ADA2 protein, when in dimer form, can exhibit a catalytic efficiency ($k_{cat}/K_M$) that is at least or at least about 1.2-fold, 1.3-fold, 1.4-fold, 1.5-fold, 1.6-fold, 1.7-fold, 1.8-fold, 1.9-fold, 2.0-fold, 2.2-fold, 2.5-fold, 3.0-fold, 3.5-fold, 4-fold, 4.5-fold, 5.0-fold, 6.0-fold, 7.0-fold, 8.0-fold, 9.0-fold, 10.0-fold or more compared to the catalytic efficiency ($k_{cat}/K_M$) of the corresponding dimer form of the unmodified ADA2 protein, wherein catalytic efficiency of adenosine deaminase activity is assessed under the same conditions. For example, the variant ADA2 protein, when in dimer form, can exhibit a catalytic efficiency ($k_{cat}/K_M$) that is at least or at least about $2\times10^4 M^{-1} s^{-1}$, $3\times10^4 M^{-1} s^{-1}$, $4\times10^4 M^{-1} s^{-1}$, $5\times10^4 M^{-1} s^{-1}$, $6\times10^4 M^{-1} s^{-1}$, $7\times10^4 M^{-1} s^{-1}$, $8\times10^4 M^{-1} s^{-1}$, $9\times10^4 M^{-1} s^{-1}$, $1\times10^5 M^{-1} s^{-1}$, $2\times10^5 M^{-1} s^{-1}$, $3\times10^5 M^{-1} s^{-1}$, $4\times10^5 M^{-1} s^{-1}$, $5\times10^5 M^{-1} s^{-1}$ or greater.

In some embodiments, the variant ADA2 protein or catalytically active portion thereof contains the modifications selected from among K371D/V99-Q144del→(GGGGS)$_1$, K371D/V99-Q144del→(GGGGS)$_2$, K371D/V99-Q144del→(GGGGS)$_3$, K371D/C105-T147del→(GGGGS)$_1$, K371D/C105-T147del→(GGGGS)$_2$, K371D/C105-T147del→(GGGGS)$_3$, R219Q/S262N/---→N1/---→A2/---→S3, K371D/C105-T147del→(Gly)n, K371D/C105-T147del→(Gly)$_{15}$, K371D/C105-T147del→(Gly)$_{10}$, K371D/C105-T147del→(Gly)$_7$, K371D/C105-T147del→(Gly)$_5$, K371D/C105-T147del→(Gly)$_3$, K371D/V99-Q144del→(GGGGS)n, K371D/C105-T147del→(GGGGS)n, K371D/N98-N156del, K371D/C105-E148del, K371D/C105-T147del and K371D/V99-Q144del. In some embodiments, the variant ADA2 protein or catalytically active portion thereof contains modifications selected from among R125N/P126A, S127N/K129S, P126N/E128T, R112N/I114T, I134N/L135C/L136T, I134N/L135S/L136T, R142N/Q144S, E137N/Y139T, P111N/G113S, F119S, F119K, Y224R, Y224N, Y191S, Y191D, F183K, Y191D/Y224R, F109S, F109A, R118D, R118A, Y139T, Y139A, W133S, W133T, P124A, P124S, V99-Q144del, V99-Q144del→(GGGGS)n, C105-T147del→(GGGGS)n, V99-Q144del→(GGGGS)$_1$, V99-Q144del→(GGGGS)$_2$, V99-Q144del→(GGGGS)$_3$, C105-T147del→(GGGGS)$_1$, C105-T147del→(GGGGS)$_2$, and C105-T147del→(GGGGS)$_3$.

In some embodiments, the variant ADA2 protein or catalytically active portion thereof contains modifications selected from among R125N/P126A, S127N/K129S, P126N/E128T, R112N/I114T, I134N/L135C/L136T, I134N/L135S/L136T, R142N/Q144S, E137N/Y139T, P111N/G113S, F119S, F119K, Y224R, Y224N, Y191S, Y191D, F183K, Y191D/Y224R, F109S, F109A, R118D, R118A, Y139T, Y139A, W133S, W133T, P124A, P124S, V99-Q144del, V99-Q144del→(GGGGS)n, C105-T147del→(GGGGS)n, V99-Q144del→(GGGGS)$_1$, V99-Q144del→(GGGGS)$_2$, V99-Q144del→(GGGGS)$_3$, C105-T147del→(GGGGS)$_1$, C105-T147del→(GGGGS)$_2$ and C105-T147del→(GGGGS)$_3$.

For example, among such variant ADA2 proteins are any that include one or more amino acid replacement(s) at an amino acid position corresponding to amino acid residue 11, 20, 219, 221, 262, 264, 366, 371, 372 or 452, with reference to amino acid positions set forth in SEQ ID NO:5. For example, the variant ADA2 protein can include one or more amino acid replacement(s) selected from among K11A, K11E, R20A, R20E, R219K, R219Q, L221A, L221V, L221G, S262N, H264Q, H264G, R366E, K371A, K371D, K371E, K372D, K372E, K452D and K452E, with reference to amino acid positions set forth in SEQ ID NO:5. In some embodiments, the variant ADA2 protein can include amino acid replacements selected from among K11A/R20A, K11A/R20A/K371A, R20A/K371A, K11A/K371A, S262N/K371D, S262N/K371E, S262N/R20E, S262N/R20E/K371D, S262N/R20E/K371E, R219Q/K371E, R219Q/K371D, R219Q/R20E, R219Q/K371E/R20E, R219Q/K371D/R20E, R219Q/S262N/K371E, R219Q/S262N/K371D, R219Q/S262N/R20E, R219Q/S262N/K371E/R20E, R219Q/S262N/K371D/R20E and R219Q/S262N, with reference to amino acid positions set forth in SEQ ID NO:5.

In some embodiments, the variant ADA2 protein, when in dimer form, can exhibit reduced heparin binding. For example, the variant ADA2 protein, when in dimer form, can exhibit no more than 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, or 95% of the heparin binding of the corresponding dimer form of the unmodified ADA2 protein, wherein heparin binding is assessed under the same conditions.

For example, among such the variant ADA2 proteins are any that include one or more amino acid replacement(s) at an amino acid position corresponding to amino acid residue 20, 262, 366, 371, 372, or 452, with reference to amino acid positions set forth in SEQ ID NO:5. For example, the variant ADA2 protein can include one or more amino acid replacement(s) selected from among R20A, R20D, R20E, S262N, R366A, R366D, R366E, K371A, K371D, K371E, K372A, K372D, K372E and K452E, with reference to amino acid positions set forth in SEQ ID NO:5. In some embodiments, the variant ADA2 protein can include amino acid replacements selected from among K11A/R20A, K11A/R20A/K371A, R20A/K371A, K11A/K371A, S262N/K371D, S262N/K371E, S262N/R20E, S262N/R20E/K371D and S262N/R20E/K371E, with reference to amino acid positions set forth in SEQ ID NO:5.

In some embodiments, the variant ADA2 protein or catalytically active portion thereof contains one or more amino acid replacement(s) corresponding to K11A; K11D; K11E; K13A; K13D; K13E; K371A; K371D; K371E; K372A; K372D; K372E; K452A; K452D; K452E; R20A; R20D; R20E; R366A; R366D; R366E; K26A; K26D; K26E; R217A; R217D; R217E; K258A; K258D; K258E; R277A; R277D; R277E; R283A; R283D; R283E; K309A; K309D; K309E; K317A; K317D; K317E; K321A; K321D; K321E; R352A; R352D; R352E; R441A; R441D; R441E; K444A; K444D; K444E; K461A; K461D; K461E; K469A; K469D; K469E; K470A; K470D; and K470E.

In some embodiments, the variant ADA2 protein, when in dimer form, can exhibit a longer serum half-life ($t_{1/2}$). For example, the variant ADA2, when in dimer form, can exhibit a half-life that is at least or at least about 110%, 120%, 130%, 140%, 150%, 160%, 170%, 180%, 190%, 200%, 225%, 250%, 300%, 350%, 400%, 450%, 500%, 600%, 700%, 800% or more longer than the half-life of the corresponding dimer form of the unmodified ADA2 protein, wherein half-life is assessed under the same conditions.

In some embodiments, the variant ADA2 protein, when in dimer form, can exhibit increased thermal stability. For example, the variant ADA2 protein, when in dimer form, can exhibit thermal stability with a melting temperature (Tm) that is increased at least or at least about 0.5° C., 1.0° C., 2.0° C., 3.0° C., 4.0° C., 5.0° C., 6.0° C., 7.0° C., 8.0° C., 9.0° C., 10.0° C. or more compared to the Tm of the corresponding dimer form of the unmodified ADA2 protein, wherein Tm is assessed under the same conditions. For example, the variant ADA2 protein can have a melting temperature (Tm) of at least or at least about 67.6° C., 67.8° C., 68.0° C., 68.2° C., 68.4° C., 68.6° C., 68.8° C., 69.0° C., 69.2° C., 69.4° C., 69.6° C., 69.8° C., 70.0° C., 70.2° C., 70.4° C., 70.6° C., 70.8° C., 71.0° C., 71.2° C., 71.4° C., 71.6° C., 71.8° C. or higher.

In examples of any of the variant ADA2 proteins provided herein, the adenosine deaminase activity of the variant ADA2 protein can be assessed or exhibited at or about pH 6.5±0.2. In some examples, the variant ADA2 protein, when in dimer form, can exhibit an altered pH optimum for adenosine deaminase activity. For example, the variant ADA2 protein, when in dimer form, can exhibit a pH optimum for adenosine deaminase activity that is at a higher pH compared to the pH optimum of the corresponding dimer form of the unmodified ADA2 protein. For example, the variant ADA2 protein, when in dimer form, can have a pH optimum with a pH that is at least or at least about 6.6, 6.7, 6.8, 6.9, 7.0, 7.1, 7.2, 7.3, 7.4, 7.5 or higher. In other examples, the variant ADA2 protein, when in dimer form, can exhibit a pH optimum for adenosine deaminase activity that is at a lower pH compared to the pH optimum of the corresponding dimer form of the unmodified ADA2 protein. For example, the variant ADA2 protein, when in dimer form, can have a pH optimum with a pH that is less than or less than about 6.5, 6.4, 6.3, 6.3, 6.2, 6.1, 6.0 or less.

In some embodiments, the variant ADA2 protein can include a modification of one or more amino acids in the putative receptor binding (PRB) domain, wherein the modification is an amino acid deletion, insertion or replacement. In any of such examples, the variant ADA2 protein does not contain a modification that is an amino acid replacement corresponding to amino acid replacement C108G, A120V, H121R, R125C, R140Q, K141R or R142W, with reference to amino acid positions set forth in SEQ ID NO:5.

In some embodiments, the variant ADA2 protein or catalytically active portion thereof lacks all or a portion of the putative receptor binding (PRB) domain or has a modification of the PRB, whereby any receptor binding or growth factor activity is reduced or eliminated or other activity of ADA2 other than deaminase activity is reduced or eliminated or interaction with the ADA domain is reduced or eliminated and the PRB domain corresponds to residues 98 to 156 set forth in SEQ ID NO:5. In some embodiments, the variant ADA2 lacks residues 105-148 or 105 to 147 or 99 to 144, with reference to amino acid positions set forth in SEQ ID NO:5. In some examples, the variant ADA2 protein or catalytically active portion thereof contains the sequence of amino acids set forth in any of SEQ ID NOS:548-550 and 579. In some embodiments, variant ADA2 protein or catalytically active portion thereof contains a deletion of all or a portion of the PRB domain and optionally an insertion of peptide linker.

In some examples, the variant ADA2 protein can have a deletion of one or more contiguous amino acid residues corresponding to any one or more contiguous amino acid residues between or between about amino acid residues 98 and 156 or amino acid residues 105 and 148, inclusive, with reference to amino acid positions set forth in SEQ ID NO:5. In any of such examples, the variant of the ADA2 polypeptide can further include substitution of the deleted region with a peptide linker. For example, the peptide linker can be selected from among (Gly)n (SEQ ID NO:368), where n is 2 to 20; (GGGGS)n (SEQ ID NO:343), where n is 1 to 6; (SSSSG)n (SEQ ID NO:344), where n is 1 to 6; (AlaAlaProAla)n (SEQ ID NO:350), where n is 1 to 6; GKSSGSGSESKS (SEQ ID NO:345); GGSTSGS-GKSSEGKG (SEQ ID NO:346); GSTSGS-GKSSSEGSGSTKG (SEQ ID NO:347); GSTSGSGKPGS-GEGSTKG (SEQ ID NO:348); and EGKSSGSGSESKEF (SEQ ID NO:349). For example, the peptide linker can be selected from among GGG (SEQ ID NO:369); GGGGG (SEQ ID NO:360); GGGGGGG (SEQ ID NO:370); GGGGGGGGGG (SEQ ID NO:371); and GGGGGGGGGGGGGGG (SEQ ID NO:372).

In some embodiments, the variant ADA2 can contain the variant ADA2 polypeptide that can include a modification in the PRB domain that corresponds to C105-T147del→(Gly)$_n$, where n is 2 to 20, such as C105-T147del→(Gly)$_{15}$, C105-T147del→(Gly)$_{10}$, C105-T147del→(Gly)$_7$, C105-T147del→(Gly)$_5$ or C105-T147del→(Gly)$_3$, with reference to amino acid positions set forth in SEQ ID NO:5. In some embodiments, the variant ADA2 can include modification in the PRB domain that corresponds to C105-T147del→(Gly) n, where n=2 to 20; C105-T147del→(Gly)$_{15}$; C105-T147del→(Gly)$_{10}$; C105-T147del→(Gly)$_7$; C105-T147del→(Gly)$_5$; C105-T147del→(Gly)$_3$; N98-N156del; C105-E148del; C105-T147del; V99-Q144del; V99-Q144del→(GGGGS)n, where n=1 to 5; C105-T147del→(GGGGS)n, where n=1 to 5; V99-Q144del→(GGGGS)$_1$; V99-Q144del→(GGGGS)$_2$; V99-Q144del→(GGGGS)$_3$; C105-T147del→(GGGGS)$_1$; C105-T147del→(GGGGS)$_2$; and C105-T147del→(GGGGS)$_3$, with reference to amino acid positions set forth in SEQ ID NO:5.

In some embodiments, the variant ADA2 protein or catalytically active portion thereof contains one or more amino acid replacement(s) selected from among replacements corresponding to F119S; F119K; Y224R; Y224N; Y191S; Y191D; F183K; Y191D/Y224R; F109S; F109A; R118D; R118A; Y139T; Y139A; W133S; W133T; P124A;

and P124S, with reference to amino acid positions set forth in SEQ ID NO:5. In some embodiments, the variant ADA2 protein or catalytically active portion thereof contains amino acid replacements selected from among replacements corresponding to R219Q/S262N/F119S; R219Q/S262N/F119K; R219Q/S262N/Y224R; R219Q/S262N/Y224N; R219Q/S262N/Y191S; R219Q/S262N/Y191D; R219Q/S262N/F183K; R219Q/S262N/Y191D/Y224R; R219Q/S262N/F109S; R219Q/S262N/F109A; R219Q/S262N/R118D; R219Q/S262N/R118A; R219Q/S262N/Y139T; R219Q/S262N/Y139A; R219Q/S262N/W133S; R219Q/S262N/W133T; R219Q/S262N/P124A; and R219Q/S262N/P124S. In some embodiments, the variant ADA2 contains modifications selected from among K371D/V99-Q144del→(GGGGS)$_1$; K371D/V99-Q144del→(GGGGS)$_2$; K371D/V99-Q144del→(GGGGS)$_3$; K371D/C105-T147del→(GGGGS)$_1$; K371D/C105-T147del→(GGGGS)$_2$; K371D/C105-T147del→(GGGGS)$_3$; R219Q/S262N/C105-T147del→(Gly)$_{15}$; R219Q/S262N/C105-T147del→(Gly)$_{10}$; R219Q/S262N/C105-T147del→(Gly)$_7$; R219Q/S262N/C105-T147del→(Gly)$_5$; R219Q/S262N/C105-T147del→(Gly)$_3$; R219Q/S262N/V99-Q144del→(GGGGS)$_1$; R219Q/S262N/V99-Q144del→(GGGGS)$_2$; R219Q/S262N/V99-Q144del→(GGGGS)$_3$; R219Q/S262N/C105-T147del→(GGGGS)$_1$; R219Q/S262N/C105-T147del→(GGGGS)$_2$; R219Q/S262N/C105-T147del→(GGGGS)$_3$; R219Q/S262N/K371D/V99-Q144del→(GGGGS)$_1$; R219Q/S262N/K371D/V99-Q144del→(GGGGS)$_2$; R219Q/S262N/K371D/V99-Q144del→(GGGGS)$_3$; R219Q/S262N/K371D/C105-T147del→(GGGGS)$_1$; R219Q/S262N/K371D/C105-T147del→(GGGGS)$_2$; R219Q/S262N/K371D/C105-T147del→(GGGGS)$_3$; K371D/C105-T147del→(Gly)n, where n=2 to 20; K371D/C105-T147del→(Gly)$_{15}$; K371D/C105-T147del→(Gly)$_{10}$; K371D/C105-T147del→(Gly)$_7$; K371D/C105-T147del→(Gly)$_5$; K371D/C105-T147del→(Gly)$_3$; K371D/V99-Q144del→(GGGGS)n, where n=1 to 5; K371D/C105-T147del→(GGGGS)n, where n=1 to 5; K371D/N98-N156del; K371D/C105-E148del; K371D/C105-T147del; K371D/V99-Q144del; R219Q/S262N/C105-T147del→(Gly)n, where n=2 to 20; R219Q/S262N/V99-Q144del→(GGGGS)n, where n=1 to 5; R219Q/S262N/C105-T147del→(GGGGS)n, where n=1 to 5; R219Q/S262N/N98-N156del; R219Q/S262N/C105-E148del; R219Q/S262N/C105-T147del; R219Q/S262N/V99-Q144del; R219Q/S262N/K371D/C105-T147del→(Gly)n, where n=2 to 20; R219Q/S262N/K371D/C105-T147del→(Gly)$_{15}$; R219Q/S262N/K371D/C105-T147del→(Gly)$_{10}$; R219Q/S262N/K371D/C105-T147del→(Gly)$_7$; R219Q/S262N/K371D/C105-T147del→(Gly)$_5$; R219Q/S262N/K371D/C105-T147del→(Gly)$_3$; R219Q/S262N/K371D/V99-Q144del→(GGGGS)n, where n=1 to 5; R219Q/S262N/K371D/C105-T147del→(GGGGS)n, where n=1 to 5; R219Q/S262N/K371D/N98-N156del; R219Q/S262N/K371D/C105-E148del; R219Q/S262N/K371D/C105-T147del; R219Q/S262N/K371D/V99-Q144del; R219Q/C105-T147del→(Gly)n, where n=2 to 20; R219Q/V99-Q144del→(GGGGS)n, where n=1 to 5; R219Q/C105-T147del→(GGGGS)n, where n=1 to 5; R219Q/N98-N156del; R219Q/C105-E148del; R219Q/C105-T147del; R219Q/V99-Q144del; S262N/C105-T147del→(Gly)n, where n=2 to 20; S262N/V99-Q144del→(GGGGS)n, where n=1 to 5; S262N/C105-T147del→(GGGGS)n, where n=1 to 5; S262N/N98-N156del; and S262N/C105-E148del; S262N/C105-T147del; and S262N/V99-Q144del.

In some embodiments of a variant ADA2 protein, including examples containing a modified PRB domain, the variant ADA2 protein, when in dimer form, can exhibit reduced binding to any one or more adenosine receptor (ADR) selected from among $A_1$, $A_{2A}$, $A_{2B}$ and $A_3$ compared to binding of the unmodified ADA2 protein to the same receptor when assessed under the same conditions. For example, the variant ADA2 protein has a binding that is reduced at least or at least about 0.5-fold, 1-fold, 1.5-fold, 2-fold, 3-fold, 4-fold, 5-fold, 6-fold, 7-fold, 8-fold, 9-fold, 10-fold or more.

In some embodiments of the variant ADA2 provided herein, the variant ADA2 can be glycosylated, for example, at a native or a non-native glycosylation site. In some embodiments, the variant ADA2 protein can include a modification(s) that alters glycosylation by introduction of a non-native glycosylation site, whereby, when expressed in a cell capable of glycosylation, the variant ADA2 protein is hyperglycosylated compared to the unmodified ADA2 polypeptide. For example, the non-native glycosylation site is introduced by amino acid replacement(s) or insertion of one, two or three amino acids. For example, the modifications are selected from among modifications corresponding to --→N1/--→A2/--→S3, R20N/V22S, K371N/D373S, K372N/I374S, T403N/H405S and G404N/P406S, with reference to amino acid positions set forth in SEQ ID NO:5. In some embodiments, the variant ADA2 or catalytically active portion thereof contains modifications corresponding to R219Q/S262N/--→N1/--→A2/--→S3; R219Q/S262N/R20N/V22S; R219Q/S262N/K371N/D373S; R219Q/S262N/K372N/I374S; R219Q/S262N/T403N/H405S; or R219Q/S262N/G404N/P406S. In some embodiments, the variant ADA2 protein or catalytically active portion thereof contains a modification in the putative receptor binding domain (PRB) corresponding to one or more of the modifications selected from among: R125N/P126A; S127N/K129S; P126N/E128T; R112N/I114T; I134N/L135C/L136T; I134N/L135S/L136T; R142N/Q144S; E137N/Y139T; and P111N/G113S. In some embodiments, the variant ADA2 protein or catalytically active portion thereof contains amino acid replacements corresponding to R219Q/S262N/R125N/P126A; R219Q/S262N/S127N/K129S; R219Q/S262N/P126N/E128T; R219Q/S262N/R112N/I114T; R219Q/S262N/I134N/L135C/L136T; R219Q/S262N/I134N/L135S/L136T; R219Q/S262N/R142N/Q144S; R219Q/S262N/E137N/Y139T; or R219Q/S262N/P111N/G113S.

In some embodiments, the variant ADA2 protein can be a human ADA2. In some embodiments, the variant ADA2 protein can be isolated or purified.

In some embodiments, the variant ADA2 protein can contain a polypeptide that exhibits at least 65% sequence identity to SEQ ID NO:5 or a catalytically active portion thereof. For example, the variant ADA2 protein can contain a polypeptide that exhibits at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to SEQ ID NO:5 or a catalytically active portion thereof. For example, the variant ADA2 protein contains a polypeptide that has the sequence of amino acids set forth in any of SEQ ID NOS:13-63 or 71-285 or a catalytically active portion thereof. In some embodiments, the variant ADA2 protein or catalytically active portion thereof contains the sequence of amino acids set forth in any of SEQ ID NOS: 551-579 or 581-993 or a catalytically active portion thereof.

In some embodiments, the variant ADA2 protein or a catalytically active portion thereof can contain amino acid replacements selected from among replacements corresponding to K11A/R20A; K11A/R20A/K371A; R20A/K371A; K11A/K371A; S262N/K371D; S262N/K371E; S262N/R20E; S262N/R20E/K371D; S262N/R20E/K371E; R219Q/K371E; R219Q/K371D; R219Q/R20E; R219Q/K371E/R20E; R219Q/K371D/R20E; R219Q/S262N/K371E; R219Q/S262N/K371D; R219Q/S262N/R20E; R219Q/S262N/K371E/R20E; R219Q/S262N/K371D/R20E; R219Q/S262N; R219Q/S262N/K11A; R219Q/S262N/K11D; R219Q/S262N/K11E; R219Q/S262N/K13A; R219Q/S262N/K13D; R219Q/S262N/K13E; R219Q/S262N/K371A; R219Q/S262N/K372A; R219Q/S262N/K372D; R219Q/S262N/K372E; R219Q/S262N/K452A; R219Q/S262N/K452D; R219Q/S262N/K452E; R219Q/S262N/R20A; R219Q/S262N/R20D; R219Q/S262N/R366A; R219Q/S262N/R366D; R219Q/S262N/R366E; R219Q/S262N/H264A; R219Q/S262N/H264Q; R219Q/S262N/H264N; R219Q/S262N/H264G; R219K/S262N; R219N/S262N; R219A/S262N; R219Q/S262N/L221A; R219Q/S262N/L221V; R219Q/S262N/L221G; R219Q/S262N/E179D; R219Q/S262N/E179A; R219Q/S262N/E179S; R219Q/S262N/E179T; R219Q/S262N/E179V; R219Q/S262N/E179G; R219Q/S262A; R219Q/S262V; R219Q/S262M; R219Q/S262N/K11A/R20A; R219Q/S262N/K11A/R20A/K371A; R219Q/S262N/R20A/K371A; R219Q/S262N/K11A/K371A; R219Q/S262N/K26A; R219Q/S262N/K26D; R219Q/S262N/K26E; R219Q/S262N/R217A; R219Q/S262N/R217D; R219Q/S262N/R217E; R219Q/S262N/K258A; R219Q/S262N/K258D; R219Q/S262N/K258E; R219Q/S262N/R277A; R219Q/S262N/R277D; R219Q/S262N/R277E; R219Q/S262N/R283A; R219Q/S262N/R283D; R219Q/S262N/R283E; R219Q/S262N/K309A; R219Q/S262N/K309D; R219Q/S262N/K309E; R219Q/S262N/K317A; R219Q/S262N/K317D; R219Q/S262N/K317E; R219Q/S262N/K321A; R219Q/S262N/K321D; R219Q/S262N/K321E; R219Q/S262N/R352A; R219Q/S262N/R352D; R219Q/S262N/R352E; R219Q/S262N/R441A; R219Q/S262N/R441D; R219Q/S262N/R441E; R219Q/S262N/K444A; R219Q/S262N/K444D; R219Q/S262N/K444E; R219Q/S262N/K461A; R219Q/S262N/K461D; R219Q/S262N/K461E; R219Q/S262N/K469A; R219Q/S262N/K469D; R219Q/S262N/K469E; R219Q/S262N/K470A; R219Q/S262N/K470D; R219Q/S262N/K470E; R219Q/S262N/D86A; R219Q/S262N/D86C; R219Q/S262N/D86E; R219Q/S262N/D86F; R219Q/S262N/D86G; R219Q/S262N/D86H; R219Q/S262N/D86I; R219Q/S262N/D86K; R219Q/S262N/D86L; R219Q/S262N/D86M; R219Q/S262N/D86N; R219Q/S262N/D86P; R219Q/S262N/D86Q; R219Q/S262N/D86R; R219Q/S262N/D86S; R219Q/S262N/D86T; R219Q/S262N/D86V; R219Q/S262N/D86W; R219Q/S262N/D86Y; R219Q/S262N/E179C; R219Q/S262N/E179F; R219Q/S262N/E179H; R219Q/S262N/E179I; R219Q/S262N/E179K; R219Q/S262N/E179L; R219Q/S262N/E179M; R219Q/S262N/E179N; R219Q/S262N/E179P; R219Q/S262N/E179Q; R219Q/S262N/E179R; R219Q/S262N/E179W; R219Q/S262N/E179Y; R219C/S262N; R219D/S262N; R219E/S262N; R219F/S262N; R219G/S262N; R219H/S262N; R219I/S262N; R219L/S262N; R219M/S262N; R219P/S262N; R219S/S262N; R219T/S262N; R219V/S262N; R219W/S262N; R219Y/S262N; R219Q/S262N/L221C; R219Q/S262N/L221D; R219Q/S262N/L221E; R219Q/S262N/L221F; R219Q/S262N/L221H; R219Q/S262N/L221I; R219Q/S262N/L221K; R219Q/S262N/L221M; R219Q/S262N/L221N; R219Q/S262N/L221P; R219Q/S262N/L221Q; R219Q/S262N/L221R; R219Q/S262N/L221S; R219Q/S262N/L221T; R219Q/S262N/L221W; R219Q/S262N/L221Y; R219Q/S262C; R219Q/S262D; R219Q/S262E; R219Q/S262F; R219Q/S262G; R219Q/S262H; R219Q/S262I; R219Q/S262K; R219Q/S262L; R219Q/S262P; R219Q/S262Q; R219Q/S262R; R219Q/S262T; R219Q/S262W; R219Q/S262Y; R219Q/S262N/H264C; R219Q/S262N/H264D; R219Q/S262N/H264E; R219Q/S262N/H264F; R219Q/S262N/H264I; R219Q/S262N/H264K; R219Q/S262N/H264L; R219Q/S262N/H264M; R219Q/S262N/H264P; R219Q/S262N/H264R; R219Q/S262N/H264S; R219Q/S262N/H264T; R219Q/S262N/H264V; R219Q/S262N/H264W; R219Q/S262N/H264Y; R219Q/S262N/S266A; R219Q/S262N/S266C; R219Q/S262N/S266D; R219Q/S262N/S266E; R219Q/S262N/S266F; R219Q/S262N/S266G; R219Q/S262N/S266H; R219Q/S262N/S266I; R219Q/S262N/S266K; R219Q/S262N/S266L; R219Q/S262N/S266M; R219Q/S262N/S266N; R219Q/S262N/S266P; R219Q/S262N/S266Q; R219Q/S262N/S266R; R219Q/S262N/S266T; R219Q/S262N/S266V; R219Q/S262N/S266W; R219Q/S262N/S266Y; R219Q/S262N/K267A; R219Q/S262N/K267C; R219Q/S262N/K267D; R219Q/S262N/K267E; R219Q/S262N/K267F; R219Q/S262N/K267G; R219Q/S262N/K267H; R219Q/S262N/K267I; R219Q/S262N/K267L; R219Q/S262N/K267M; R219Q/S262N/K267N; R219Q/S262N/K267P; R219Q/S262N/K267Q; R219Q/S262N/K267R; R219Q/S262N/K267S; R219Q/S262N/K267T; R219Q/S262N/K267V; R219Q/S262N/K267W; R219Q/S262N/K267Y; R219Q/S262N/V296A; R219Q/S262N/V296C; R219Q/S262N/V296D; R219Q/S262N/V296E; R219Q/S262N/V296F; R219Q/S262N/V296G; R219Q/S262N/V296H; R219Q/S262N/V296I; R219Q/S262N/V296K; R219Q/S262N/V296L; R219Q/S262N/V296M; R219Q/S262N/V296N; R219Q/S262N/V296P; R219Q/S262N/V296Q; R219Q/S262N/V296R; R219Q/S262N/V296S; R219Q/S262N/V296T; R219Q/S262N/V296W; R219Q/S262N/V296Y; R219Q/K11A/R20A; R219Q/K11A/R20A/K371A; R219Q/R20A/K371A; R219Q/K11A/K371A; S262N/K11A/R20A; S262N/K11A/R20A/K371A; S262N/R20A/K371A; and S262N/K11A/K371A, with reference to SEQ ID NO:5.

The variant ADA2 protein can be a monomer or a dimer. In particular, among variant ADA2 proteins provided herein are dimers of a variant ADA2 protein, that can include any of the variant ADA2 proteins provided. In some examples, the dimer can be a homodimer. In other examples, the dimer can be a heterodimer.

Provided are nucleic acid molecules encoding the variant ADA2 proteins provided herein. Also provided herein is a vector that includes the nucleic acid encoding any of the variant ADA2 proteins provided herein. The vector can be a eukaryotic or a prokaryotic vector, such as a mammalian vector or a viral vector. For example, the vector is an adenovirus vector, an adeno-associated-virus vector, a retrovirus vector, a herpes virus vector, a lentivirus vector, a poxvirus vector, or a cytomegalovirus vector. In some embodiments, the vector is an oncolytic vector. In some embodiments, the vector can also encode a soluble hyaluronidase. Also provided herein are cells containing any of the vectors provided herein. The cell can be a eukaryotic cell, such as a mammalian cell. If human, the cells are isolated or are provided as a cell culture. For example, the cell is a mammalian cell, such as a Chinese Hamster Ovary (CHO) cell. In some embodiments, the cell can expresses the variant ADA2 protein, such as a dimer. Also provided herein are variant ADA2 proteins, such as variant ADA2 dimers, that are produced by the cell provided herein. In some embodiments, the cell is an isolated cell or a cell culture, such as a eukaryotic cell, a non-human cell, a mammalian cell, or a cell that is not a human stem cell. In some embodiments, the cell is an immune cell, such as a T cell, a tumor-infiltrating lymphocyte (TIL), a cytotoxic T lymphocyte (CTL), a natural killer (NK) cell or a lymphokine-activated killer (LAK) cell. In some embodiments, the cell is a T cell that encodes and expresses chimeric antigen receptor (CAR) and the variant ADA2 protein or dimer. In some examples, the CAR is specific for a tumor cell antigen, and the tumor antigen is selected from among HER2, CD19, HERV-K, CD20, CD22, ROR1, mesothelin, CD33/IL3Ra, c-Met, PSMA, Glycolipid F77, EGFRvIII, GD-2, NY-ESO-1 TCR, MAGE A3 TCR and GD2 and combinations thereof.

Provided herein are conjugates include a variant ADA2 protein or a catalytically active portion of any ADA2 protein provided herein, such as a variant ADA2 dimer provided in any examples herein, linked directly or indirectly via a linker to a heterologous moiety, such as a toxin or therapeutic drug.

Also provided herein are conjugates that include an ADA2 protein linked directly or indirectly via a linker to a heterologous moiety. In any of the conjugates, the ADA2 protein can be a monomer or a dimer. In some examples, the dimer is a homodimer; in other it is a heterodimer. In any of the conjugates in the examples herein, the heterologous moiety is conjugated to one or both subunits in the dimer. The heterologous moiety, for example, can be selected from among a peptide, small molecule, nucleic acid, carbohydrate and polymer.

In some embodiments of the conjugates provided herein, the heterologous moiety is a half-life extending moiety. For example, the half-life extending moiety is selected from among biocompatible fatty acids and derivatives thereof, hydroxy alkyl starch (HAS), polyethylene glycol (PEG), Poly (Gly$_x$-Ser$_y$)$_n$, homo-amino-acid polymers (HAP), hyaluronic acid (HA), heparosan polymers (HEP), phosphorylcholine-based polymers (PC polymer), Fleximers, dextran, polysialic acids (PSA), Fc domain, Transferrin, Albumin, elastin-like peptides, XTEN sequences, albumin binding peptides, a CTP peptide, and any combination thereof.

In some examples, the half-life extending moiety is a PEG and the ADA2 protein is PEGylated. For example, the PEG can be selected from among methoxy-polyethylene glycols (mPEG), PEG-glycidyl ethers (Epox-PEG), PEG-oxycarbonylimidazole (CDI-PEG), branched PEGs and polyethylene oxide (PEO). In some examples, the PEG has a molecular weight of from or from about 1 kDa to about 100 kDa. The PEG can be linear or branched. In some embodiments of conjugates provided herein, the PEG moieties result from reaction with a PEG reagent selected from among mPEG-Succinimidyl Propionates (mPEG-SPA), mPEG Succinimidyl Carboxymethyl Ester (mPEG-SCM), mPEG-Succinimidyl Butanoates (mPEG-SBA), mPEG2-N-Hydroxylsuccinimide, mPEG-succinimidyl butanoate (mPEG-SBA), mPEG-succinimidyl α-methylbutanoate (mPEG-SMB), mPEG-butyrldehyde, PEG-p-nitrophenyl-carbonate and PEG-propionaldehyde. For example, the PEG moieities result from reaction with a PEG reagent selected from among mPEG-SCM (20 kDa), mPEG-SCM (30 kDa), mPEG-SBA (5 kDa), mPEG-SBA (20 kDa), mPEG-SBA (30 kDa), mPEG-SMB (20 kDa), mPEG-SMB (30 kDa), mPEG-butyrldehyde (30 kDa), mPEG-SPA (20 kDa), mPEG-SPA (30 kDa), mPEG2-NHS (10 kDa branched), mPEG2-NHS (20 kDa branched), mPEG2-NHS (40 kDa branched), mPEG2-NHS (60 kDa branched), PEG-NHS-biotin (5 kDa biotinylated), PEG-p-nitrophenyl-carbonate (30 kDa) and PEG-propionaldehyde (30 kDa).

In embodiments of the conjugates provided herein, the ADA2 protein can contain the sequence of amino acids set forth in any of SEQ ID NOS:5, 326-334, 340, 375 or 380-383, a sequence that exhibits at least 85% sequence identity to the sequence of amino acids set forth in any of SEQ ID NOS:5, 326-334, 340, 375 or 380-383 or a catalytically active form thereof. For example, the ADA2 protein can contain a sequence of amino acids that exhibits at least 85%, 86%, 87%, 88%, 89%, 90%, 91%, 92%, 93%, 94%, 95%, 96%, 97%, 98%, 99% or more sequence identity to the sequence of amino acids set forth in any of SEQ ID NOS:5, 326-334, 340, 375 or 380-383 or a catalytically active portion thereof. For example, the ADA2 protein can contain a sequence of amino acids that exhibits at least 85%, 86%, 87%, 88%, 89%, 90%, 91%, 92%, 93%, 94%, 95%, 96%, 97%, 98%, 99% or more sequence identity to the sequence of amino acids set forth in SEQ ID NOS:5 or a catalytically active portion thereof. In another example, the ADA2 protein can include a polypeptide having the sequence of amino acids set forth in SEQ ID NO:5 or a catalytically active portion thereof.

In embodiments of conjugates provided herein, the ADA2 protein is a variant ADA2 protein that contains a sequence of amino acids that includes a modification(s) in the sequence of amino acids of an unmodified ADA2 protein or a catalytically active portion thereof, where the unmodified ADA2 protein contains the sequence of amino acids set forth in SEQ ID NO:5, or a sequence of amino acids that exhibits at least 85% sequence identity to the sequence of amino acids set forth in SEQ ID NO:5, or is a catalytically active portion thereof. In any of such examples, the amino acid modification(s) are selected from among amino acid replacement(s), deletion(s) and insertion(s); and the variant ADA2 protein, when in dimer form, can exhibit adenosine deaminase activity to convert adenosine to inosine. In any of the conjugates provided herein, the ADA2 protein, when in dimer form, can exhibit a catalytic efficiency ($k_{cat}/K_M$) that is at least or at least about $5\times10^3$ M$^{-1}$ s$^{-1}$, $6\times10^3$ M$^{-1}$ s$^{-1}$, $7\times10^3$ M$^{-1}$ s$^{-1}$, $8\times10^3$M$^{-1}$ s$^{-1}$, $9\times10^3$ M$^{-1}$ s$^{-1}$, $1\times10^4$ M$^{-1}$ s$^{-1}$, $2\times10^4$ M$^{-1}$ s$^{-1}$, $3\times10^4$ M$^{-1}$ s$^{-1}$, $4\times10^4$ M$^{-1}$ s$^{-1}$, $5\times10^4$ M$^{-1}$ s$^{-1}$, $6\times10^4$ M$^{-1}$ s$^{-1}$, $7\times10^4$ M$^{-1}$ s$^{-1}$, $8\times10^4$ M$^{-1}$ s$^{-1}$, $9\times10^4$ M$^{-1}$ s$^{-1}$, $1\times10^5$ M$^{-1}$ s$^{-1}$, $2\times10^5$ M$^{-1}$ s$^{-1}$, $3\times10^5$ M$^{-1}$ s$^{-1}$, $4\times10^5$ M$^{-1}$ s$^{-1}$, $5\times10^5$ M$^{-1}$ s$^{-1}$ or greater.

In any of the embodiments of conjugates provided herein, the modification(s) of the ADA2 protein can be an amino acid replacement(s); and the variant ADA2 protein can include one or more amino acid replacement(s) at an amino acid position corresponding to amino acid residue 11, 13, 20, 22, 26, 86, 179, 217, 219, 221, 258, 262, 264, 266, 267, 277, 283, 296, 309, 317, 321, 352, 366, 371, 372, 373, 374, 403, 404, 405, 406, 441, 444, 452, 461, 469 or 470, with reference to amino acid positions set forth in SEQ ID NO:5. For example, in some embodiments of conjugates provided herein, the variant ADA2 protein can include one or more amino acid replacement(s) selected from among K11A, K11D, K11E, K13A, K13D, K13E, R20A, R20D, R20E, R20N, V22S, K26A, K26D, K26E, D86A, D86C, D86E, D86F, D86G, D86H, D86I, D86K, D86L, D86M, D86N, D86P, D86Q, D86S, D86T, D86V, D86W, D86Y, E179A, E179C, E179D, E179F, E179G, E179H, E179I, E179K, E179L, E179M, E179N, E179P, E179Q, E179R, E179S, E179T, E179V, E179W, E179Y, R217A, R217D, R217E, R219A, R219C, R219D, R219E, R219F, R219G, R219H, R219I, R219K, R219L, R219M, R219N, R219P, R219Q, R219S, R219T, R219V, R219W, R219Y, L221A, L221C, L221D, L221E, L221F, L221G, L221H, L221I, L221K, L221M, L221N, L221P, L221Q, L221R, L221S, L221T, L221V, L221W, L221Y, K258A, K258D, K258E, S262A, S262C, S262D, S262E, S262F, S262G, S262H, S262I, S262K, S262L, S262M, S262N, S262P, S262Q, S262R, S262T, S262V, S262W, S262Y, H264A, H264C, H264D, H264E, H264F, H264G, H264I, H264K, H264L, H264M, H264N, H264P, H264Q, H264R, H264S, H264T, H264V, H264W, H264Y, S266A, S266C, S266D, S266E, S266F, S266G, S266H, S266I, S266K, S266L, S266M, S266N, S266P, S266Q, S266R, S266T, S266V, S266W, S266Y, K267A, K267C, K267D, K267E, K267F, K267G, K267H, K267I, K267L, K267M, K267N, K267P, K267Q, K267R, K267S, K267T, K267V, K267W, K267Y, R277A, R277D, R277E, R283A, R283D, R283E, V296A, V296C, V296D, V296E, V296F, V296G, V296H, V296I, V296K, V296L, V296M, V296N, V296P, V296Q, V296R, V296S, V296T, V296W, V296Y, K309A, K309D, K309E, K317A, K317D, K317E, K321A, K321D, K321E, R352A, R352D, R352E, R366A, R366D, R366E, K371A, K371D, K371E, K371N, K372A, K372D, K372E, K372N, D373S, I374S, T403N, G404N, H405S, P406S, R441A, R441D, R441E, K444A, K444D, K444E, K452A, K452D, K452E, K461A, K461D, K461E, K469A, K469D, K469E, K470A, K470D, and K470E, with reference to amino acid positions set forth in SEQ ID NO:5. For example, the variant ADA2 protein can include one or more amino acid replacement(s) selected from among K11A, K11E, R20A, R20D, R20E, R219K, R219Q, L221A, L221V, L221G, S262N, H264Q, H264G, R366A, R366D, R366E, K371A, K371D, K371E, K372A, K372D, K372E, K452D and K452E, with reference to amino acid positions set forth in SEQ ID NO:5. In some examples, the variant ADA2 protein can include amino acid replacements selected from among K11A/R20A, K11A/R20A/K371A, R20A/K371A, K11A/K371A, S262N/K371D, S262N/K371E, S262N/R20E, S262N/R20E/K371D, S262N/R20E/K371E, R219Q/K371E, R219Q/K371D, R219Q/R20E, R219Q/K371E/R20E, R219Q/K371D/R20E, R219Q/S262N/K371E, R219Q/S262N/K371D, R219Q/S262N/R20E, R219Q/S262N/K371E/R20E, R219Q/S262N/K371D/R20E and R219Q/S262N, with reference to amino acid positions set forth in SEQ ID NO:5.

In some embodiments of conjugates provided herein, the variant ADA2 protein can include a modification of one or more amino acids in the putative receptor binding (PRB) domain that is an amino acid deletion, insertion or replacement. For example, in some embodiments of conjugates provided herein, the variant ADA2 protein can include deletion of one or more contiguous amino acid residues corresponding to any one or more contiguous amino acid residues between or between about amino acid residues 98 and 156 or amino acid residues 105 and 148, inclusive, with reference to amino acid positions set forth in SEQ ID NO:5. In some examples, the variant ADA2 protein in the conjugate can further include substitution of the deleted region with a peptide linker. For example, the peptide linker can be selected from among (Gly)n (SEQ ID NO:368), where n is 2 to 20; (GGGGS)n (SEQ ID NO:343), where n is 1 to 6; (SSSSG)n (SEQ ID NO:344), where n is 1 to 6; (AlaAlaProAla)n (SEQ ID NO:350), where n is 1 to 6; GKSSGSGSESKS (SEQ ID NO:345); GGSTSGS-GKSSEGKG (SEQ ID NO:346); GSTSGS-GKSSSEGSGSTKG (SEQ ID NO:347); GSTSGSGKPGS-GEGSTKG (SEQ ID NO:348); and EGKSSGSGSESKEF (SEQ ID NO:349). In some examples, the peptide linker is selected from among GGG (SEQ ID NO:369); GGGGG (SEQ ID NO:360); GGGGGG (SEQ ID NO:370); GGGGGGGGGG (SEQ ID NO:371); and GGGGGGGGGGGGGGG (SEQ ID NO:372). For example, the modification in the PRB domain can correspond to C105-T147del→(Gly)$_n$, where n is 2 to 20, such as, C105-T147del→(Gly)$_{15}$, C105-T148del→(Gly)$_{10}$, C105-T147del→(Gly)$_7$, C105-T147del→(Gly)$_5$ or C105-T147del→(Gly)$_3$, with reference to amino acid positions set forth in SEQ ID NO:5.

In some embodiments of conjugates provided herein, the ADA2 protein in the conjugate can be glycosylated at one or more native or non-native glycosylation sites. For example, in some embodiments of conjugates provided herein containing a variant ADA2 protein, the variant ADA2 protein in the conjugate can include a modification(s) that alters glycosylation by introduction of a non-native glycosylation site. The non-native glycosylation site can be introduced by creating the canonical glycosylation sequence (NXT/S, where X is not Pro for N-linked carbohydrates, S/T for O-linked) by introducing amino acid replacement(s), insertions or deletions of one, two or three amino acids. For example, the modifications that alter glycosylation are selected from among modifications corresponding to ---→N1/---→A2/---→S3, R20N/V22S, K371N/D373S, K372N/I374S, T403N/H405S and G404N/P406S, with reference to amino acid positions set forth in SEQ ID NO:5.

In some embodiments of conjugates provided herein, the variant ADA2 protein in the conjugate can have the sequence of amino acids set forth in any of SEQ ID NOS:13-63 or 71-285 or a catalytically active portion thereof.

In some embodiments of conjugates containing an ADA2 or variant ADA2 protein provided herein, the conjugate retains the adenosine deaminase activity compared to the ADA2 protein that is not conjugated. For example, the conjugate can exhibit from or from about 50% to 500%, 50% to 200%, 50% to 100%, 50% to 80%, 80% to 500%, 80% to 200%, 80% to 100%, 100% to 500% or 100% to 200%, each inclusive, of the adenosine deaminase activity of the ADA2 protein that is not conjugated, such as at least 50%, 60%, 70%, 80%, 90%, 100%, 110%, 120%, 130%, 140%, 150%, 160%, 170%, 180%, 190%, 200%, 300%, 400%, 500% or more the adenosine deaminase activity of the ADA2 protein that is not conjugated. In some embodiments of conjugates provided herein, the ADA2 in the conjugate can exhibit a catalytic efficiency ($k_{cat}/K_M$) that is at least or at least about $5\times10^3$ M$^{-1}$ s$^{-1}$, $6\times10^3$ M$^{-1}$ s$^{-1}$, $7\times10^3$ M$^{-1}$ s$^{-1}$, $8\times10^3$ M$^{-1}$ s$^{-1}$, $9\times10^3$ M$^{-1}$ s$^{-1}$, $1\times10^4$ M$^{-1}$ s$^{-1}$, $2\times10^4$ M$^{-1}$ s$^{-1}$, $3\times10^4$ M$^{-1}$ s$^{-1}$, $4\times10^4$ M$^{-1}$ s$^{-1}$, $5\times10^4$ M$^{-1}$ s$^{-1}$, $6\times10^4$ M$^{-1}$ s$^{-1}$, $7\times10^4$ M$^{-1}$ s$^{-1}$, $8\times10^4$ M$^{-1}$ s$^{-1}$, $9\times10^4$ M$^{-1}$ s$^{-1}$, $1\times10^5$ M$^{-1}$ s$^{-1}$, $2\times10^5$ M$^{-1}$ s$^{-1}$, $3\times10^5$ M$^{-1}$ s$^{-1}$, $4\times10^5$ M$^{-1}$ s$^{-1}$, $5\times10^5$ M$^{-1}$ s$^{-1}$ or greater.

Provided herein are combinations containing any of the variant ADA2 proteins or a catalytically active portion thereof provided herein, any variant ADA2 dimer provided herein or any conjugate of any of the examples provided herein, and a therapeutic agent. Also provided herein are combinations containing any ADA2 protein; and a therapeutic agent. In any examples of the combination provided herein, the ADA2 protein can be a monomer or a dimer. For example, the ADA2 protein can be a dimer, such as a homodimer.

In some embodiments of combinations provided herein, the therapeutic agent can be selected from among an antibody, cytotoxic agent, chemotherapeutic agents, cytokine, growth inhibitory agent, anti-hormonal agent, kinase inhibitor, anti-angiogenic agent, cardioprotectant, immunostimulatory agent, immunosuppressive agent, immune checkpoint inhibitor, antibiotic and angiogenesis inhibitor. For example, the therapeutic agent can be an anti-cancer agent. In some embodiments of combinations provided herein, the anti-cancer agent can be an anti-cancer antibody, a chemotherapeutic agent, a radioimmunotherapeutic, an anti-angiogenic agent or an immune checkpoint inhibitor.

For example, the anti-cancer agent can be an immune checkpoint inhibitor; and the target of the immune checkpoint inhibitor can be selected from among CTLA4, PD-1, and PD-L1. In some embodiments of combinations provided herein, the immune checkpoint inhibitor can be an antibody, a fusion protein, an aptamer, or an immune checkpoint protein-binding fragment thereof. For example, the immune checkpoint inhibitor is an anti-immune checkpoint protein antibody or antigen-binding fragment thereof. In particular examples, the immune checkpoint inhibitor is selected from among: an anti-CTLA4 antibody, derivative thereof, or antigen-binding fragment thereof; an anti-PD-L1 antibody, derivative thereof, or antigen-binding fragment thereof; and an anti-PD-1 antibody, derivative thereof, or antigen-binding fragment thereof. For example, the immune checkpoint inhibitor can be selected from among: Ipilimumab, a derivative thereof, or an antigen-binding fragment thereof; Tremelimumab, a derivative thereof, or an antigen-binding fragment thereof, Nivolumab, a derivative thereof, or an antigen-binding fragment thereof, and Pidilizumab, a derivative thereof, or an antigen-binding fragment thereof.

In some embodiments of combinations provided herein, the therapeutic agent can be an anti-hyaluronan agent. For example, the anti-hyaluronan agent can be a soluble hyaluronidase. In some embodiments of combinations provided herein, the soluble hyaluronidase can exhibit hyaluronidase activity at neutral pH. In particular, the soluble hyaluronidase can be selected from among bovine, ovine or a C-terminal truncated human PH20 that lacks all or a portion of the glycosylphosphatidylinositol (GPI) anchor attachment sequence. For example, the soluble hyaluronidase is a C-terminally truncated human PH20 that lacks all or a portion of the GPI anchor attachment sequence, such as those set forth in any of SEQ ID NOS:481-488, 493-514, or 526-532, or that has a sequence of amino acids that has at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS:481-488, 493-514, or 526-532 and is soluble and retains hyaluronidase activity. In some embodiments of combinations provided herein, the anti-hyaluronan agent or soluble hyaluronidase can be conjugated to a polymer, such as a PEG moiety.

In some embodiments of combinations provided herein, the ADA2 protein can include a polypeptide having the sequence of amino acids set forth in any of SEQ ID NOS:5, 326-334, 340, 375 or 380-383, a sequence that can exhibit at least 85% sequence identity to the sequence of amino acids set forth in SEQ ID NOS:5, 326-334, 340, 375 or 380-383 or a catalytically active form thereof. For example, the ADA2 protein can include a protein having a sequence of amino acids that can exhibit at least 86%, 87%, 88%, 89%, 90%, 91%, 92%, 93%, 94%, 95%, 96%, 97%, 98%, 99% or more sequence identity to the sequence of amino acids set forth in SEQ ID NOS:5, 326-334, 340, 375 or 380-383 or a catalytically active portion thereof. In particular examples, the ADA2 protein can contain a sequence of amino acids that can exhibit at least 86%, 87%, 88%, 89%, 90%, 91%, 92%, 93%, 94%, 95%, 96%, 97%, 98%, 99% or more sequence identity to the sequence of amino acids set forth in SEQ ID NO:5. For example, the ADA2 protein can contain the sequence of amino acids set forth in SEQ ID NO:5.

In some embodiments of combinations provided herein, the ADA2 protein is a variant ADA2 protein having a sequence of amino acids that includes a modification(s) in the sequence of amino acids of an unmodified ADA2 polypeptide or a catalytically active portion thereof. In any of such examples, the unmodified ADA2 protein can include the sequence of amino acids set forth in SEQ ID NO:5, or a sequence of amino acids that can exhibit at least 85% sequence identity to the sequence of amino acids set forth in SEQ ID NO:5, or is a catalytically active portion thereof; the amino acid modification(s) are selected from among amino acid replacement(s), deletion(s) and insertion(s); and the variant ADA2 protein, when in dimer form, can exhibit adenosine deaminase activity to convert adenosine to inosine.

In some embodiments of combinations provided herein, the ADA2 protein, when in dimer form, can exhibit a catalytic efficiency ($k_{cat}/K_M$) that is at least or at least about $5 \times 10^3$ $M^{-1}$ $s^{-1}$, $6 \times 10^3$ $M^{-1}$ $s^{-1}$, $7 \times 10^3$ $M^{-1}$ $s^{-1}$, $8 \times 10^3$ $M^{-1}$ $s^{-1}$, $9 \times 10^3$ $M^{-1}$ $s^{-1}$, $1 \times 10^4$ $M^{-1}$ $s^{-1}$, $2 \times 10^4$ $M^{-1}$ $s^{-1}$, $3 \times 10^4$ $M^{-1}$ $s^{-1}$, $4 \times 10^4$ $M^{-1}$ $s^{-1}$, $5 \times 10^4$ $M^{-1}$ $s^{-1}$, $6 \times 10^4$ $M^{-1}$ $s^{-1}$, $7 \times 10^4$ $M^{-1}$ $8 \times 10^4$ $M^{-1}$ $s^{-1}$, $9 \times 10^4$ $M^{-1}$ $s^{-1}$, $1 \times 10^5$ $M^{-1}$ $s^{-1}$, $2 \times 10^5$ $M^{-1}$ $s^{-1}$, $3 \times 10^5$ $M^{-1}$ $s^{-1}$, $4 \times 10^5$ $M^{-1}$ $s^{-1}$, $5 \times 10^5$ $M^{-1}$ $s^{-1}$ or greater.

In some embodiments of combinations provided herein, the modification(s) in the sequence of amino acids of an unmodified ADA2 protein can include an amino acid replacement(s); and the variant ADA2 protein can include one or more amino acid replacement(s) at an amino acid position corresponding to amino acid residue 11, 13, 20, 22, 26, 86, 179, 217, 219, 221, 258, 262, 264, 266, 267, 277, 283, 296, 309, 317, 321, 352, 366, 371, 372, 373, 374, 403, 404, 405, 406, 441, 444, 452, 461, 469 or 470, with reference to amino acid positions set forth in SEQ ID NO:5. For example, the variant ADA2 protein can include one or more amino acid replacement(s) selected from among K11A, K11D, K11E, K13A, K13D, K13E, R20A, R20D, R20E, R20N, V22S, K26A, K26D, K26E, D86A, D86C, D86E, D86F, D86G, D86H, D86I, D86K, D86L, D86M, D86N, D86P, D86Q, D86R, D86S, D86T, D86V, D86W, D86Y, E179A, E179C, E179D, E179F, E179G, E179H, E179I, E179K, E179L, E179M, E179N, E179P, E179Q, E179R, E179S, E179T, E179V, E179W, E179Y, R217A, R217D, R217E, R219A, R219C, R219D, R219E, R219F, R219G, R219H, R219I, R219K, R219L, R219M, R219N, R219P, R219Q, R219S, R219T, R219V, R219W, R219Y, L221A, L221C, L221D, L221E, L221F, L221G; L221H, L221I, L221K, L221M, L221N, L221P, L221Q, L221R, L221S, L221T, L221V, L221W, L221Y, K258A, K258D, K258E, S262A, S262C, S262D, S262E, S262F, S262G, S262H, S262I, S262K, S262L, S262M, S262N, S262P, S262Q, S262R, S262T, S262V, S262W, S262Y, H264A, H264C, H264D, H264E, H264F, H264G, H264I, H264K, H264L, H264M, H264N, H264P, H264Q, H264R, H264S, H264T, H264V, H264W, H264Y, S266A, S266C, S266D, S266E, S266F, S266G, S266H, S266I, S266K, S266L, S266M, S266N, S266P, S266Q, S266R, S266T, S266V, S266W, S266Y, K267A, K267C, K267D, K267E, K267F, K267G, K267H, K267I, K267L, K267M, K267P, K267Q, K267R, K267S, K267T, K267V, K267W, K267Y, R277A, R277D, R277E, R283A, R283D, R283E, V296A, V296C, V296D, V296E, V296F, V296G, V296H, V296I, V296K, V296L, V296M, V296N, V296P, V296Q, V296R, V296S, V296T, V296W, V296Y, K309A, K309D, K309E, K317A, K317D, K317E, K321A, K321D, K321E, K352A, R352D, R352E, R366A, R366D, R366E, K371A, K371D, K371E, K371N, K372A, K372D, K372E, K372N, D373S, I374S, T403N, G404N, H405S, P406S, R441A, R441D, R441E, K444A, K444D, K444E, K452A, K452D, K452E, K461A, K461D, K461E, K469A, K469D, K469E, K470A, K470D, and K470E, with reference to amino acid positions set forth in SEQ ID NO:5. In particular examples, the variant ADA2 protein can include one or more amino acid replacement(s) selected from among K11A, K11E, R20A, R20D, R20E, R219K, R219Q, L221A, L221V, L221G, S262N, H264Q, H264G, R366A, R366D, R366E, K371A, K371D, K371E, K372A, K372D, K372E, K452D and K452E, with reference to amino acid positions set forth in SEQ ID NO:5. In some examples of the combinations provided herein, the variant ADA2 protein can include amino acid replacements selected from among K11A/R20A, K11A/R20A/K371A, R20A/K371A, K11A/K371A, S262N/K371D, S262N/K371E, S262N/R20E, S262N/R20E/K371D, S262N/R20E/K371E, R219Q/K371E, R219Q/K371D, R219Q/R20E, R219Q/K371E/R20E, R219Q/K371D/R20E, R219Q/S262N/K371E, R219Q/S262N/K371D, R219Q/S262N/R20E, R219Q/S262N/K371E/R20E, R219Q/S262N/K371D/R20E and R219Q/S262N, with reference to amino acid positions set forth in SEQ ID NO:5.

In some embodiments of combinations provided herein, the variant ADA2 protein can include a modification of one or more amino acids in the putative receptor binding (PRB) domain, wherein the modification is an amino acid deletion, insertion or replacement. For example, the variant ADA2 can include deletion of one or more contiguous amino acid residues corresponding to any one or more contiguous amino acid residues between or between about amino acid residues 98 and 156 or amino acid residues 105 and 148, inclusive, with reference to amino acid positions set forth in SEQ ID NO:5. In some embodiments, the variant of ADA2 polypeptide can further include substitution of the deleted region with a peptide linker. For example, the peptide linker can be selected from among (Gly)n (SEQ ID NO:368), where n is 2 to 20; (GGGGS)n (SEQ ID NO:343), where n is 1 to 6; (SSSSG)n (SEQ ID NO:344), where n is 1 to 6; (AlaAlaProAla)n (SEQ ID NO:350), where n is 1 to 6; GKSSGSGSESKS (SEQ ID NO:345); GGSTSGS-GKSSEGKG (SEQ ID NO:346); GSTSGS-GKSSSEGSGSTKG (SEQ ID NO:347); GSTSGSGKPGS-GEGSTKG (SEQ ID NO:348); and EGKSSGSGSESKEF (SEQ ID NO:349). In particular examples, the peptide linker is selected from among GGG (SEQ ID NO:369); GGGGG (SEQ ID NO:360); GGGGGGG (SEQ ID NO:370); GGGGGGGGGG (SEQ ID NO:371); and GGGGGGGGGGGGGGG (SEQ ID NO:372). In some embodiments of combinations provided herein, the modification in the PRB domain of the variant ADA2 polypeptide corresponds to C105-T147del→(Gly)$_n$, where n is 2 to 20, such as C105-T147del→(Gly)$_{15}$, C105-T147del→(Gly)$_{10}$, C105-T147del→(Gly)$_7$, C105-T147del→(Gly)$_5$ or C105-T147del→(Gly)$_3$, with reference to amino acid positions set forth in SEQ ID NO:5.

In some embodiments of combinations provided herein, the ADA2 protein in the combination can be glycosylated at one or more native or non-native glycosylation sites. For example, in some embodiments of combinations provided herein containing a variant ADA2 protein, the variant ADA2 protein in the combination include a modification(s) that alters glycosylation by introduction of a non-native glyco-sylation site. The non-native glycosylation site is introduced by amino acid replacement(s) or insertion of one, two or three amino acids. For example, the modifications that alter hyperglycosylation can be selected from among modifications corresponding to --→N1/--→A2/--→S3, R20N/V22S, K371N/D373S, K372N/I374S, T403N/H405S and G404N/P406S, with reference to amino acid positions set forth in SEQ ID NO:5.

In some embodiments of combinations provided herein, the variant ADA2 polypeptide has the sequence of amino acids set forth in any of SEQ ID NOS:13-63 or 71-285 or a catalytically active portion thereof.

Provided herein are pharmaceutical compositions that can include any of the variant ADA2 proteins or a catalytically active portion thereof provided herein, any variant ADA2 dimer provided herein or any conjugate provided herein, in a pharmaceutically acceptable vehicle. In some embodiments, the pharmaceutical composition can be formulated for local or systemic administration. For example, the pharmaceutical composition is formulated for intravenous administration.

Provided herein are methods of treating a tumor or cancer in a subject, that can include administering to the subject any of the variant ADA2 proteins or a catalytically active portion thereof provided herein, any variant ADA2 dimer provided herein, any conjugate provided herein, or any combination provided herein. Also provided are medical uses or pharmaceutical compositions for use of any of the variant ADA2 proteins or a catalytically active portion thereof provided herein, any variant ADA2 dimer provided herein or any conjugate provided herein for treating a tumor or a cancer in a subject. Also provided are combinations for use of any of the combinations provided herein for use in treating a tumor or cancer.

Also provided herein are methods of treating a tumor or cancer in a subject that can include administering to the subject any ADA2 protein. Also provided are medical uses of an ADA2 protein or pharmaceutical composition for use containing an ADA2 protein for treating a tumor or a cancer. Also provided are combinations for use containing an ADA2 protein and a therapeutic agent for treating a tumor or cancer.

In some embodiments of methods, uses, pharmaceutical compositions for use or uses provided herein, the tumor can be a solid tumor or a metastatic tumor. In particular examples, the tumor can be a carcinoma, gliomas, sarcoma, adenocarcinoma, adenosarcoma, or adenoma. In some embodiments, the tumor can be a tumor of the breast, heart, lung, small intestine, colon, spleen, kidney, bladder, head and neck, ovary, prostate, brain, pancreas, skin, bone, bone marrow, blood, thymus, uterus, testicles, cervix or liver.

In some embodiments of methods provided herein, the subject can be selected for treatment based on elevated levels of plasma adenosine, tumor-associated expression of adenosine receptor (ADR) or tumor-associated expression of a nucleotidase. In particular examples, the ADR is A2A or A2B. In particular examples, the nucleotidase is CD39 or CD73. In some embodiments of methods provided herein, the elevated level is at least 0.5-fold, 1-fold, 2-fold, 3-fold, 4-fold, 5-fold, 6-fold, 7-fold, 8-fold, 9-fold, 10-fold, 15-fold, 20-fold, 30-fold, 40-fold, 50-fold, 60-fold, 70-fold, 80-fold, 90-fold, 100-fold, 150-fold, 200-fold, 500-fold, 1000-fold or more, compared to the predetermined level or predetermined amount or control sample.

In some embodiments of methods provided herein, the method of treating a tumor or cancer in a subject can further include administration of one or more anticancer agents or treatments. For example, the anti-cancer agent can be selected from among an anti-cancer antibody, a chemotherapeutic agent, a radioimmunotherapeutic, an anti-angiogenic agent and an immune checkpoint inhibitor.

Provided herein are methods of treating a disease or condition in a subject, that can include administering to the subject any of the variant ADA2 proteins or a catalytically active portion thereof provided herein, any variant ADA2 dimer provided herein, any conjugate provided herein, or any combination provided herein for treating a disease or condition that is a non-cancer hyperproliferative disease, a fibrotic disease, an infectious disease, a vasculopathy or Severe Combined Immunodeficiency (SCID). Also provided are medical uses or pharmaceutical compositions for use of any of the variant ADA2 proteins or a catalytically active portion thereof provided herein, any variant ADA2 dimer provided herein or any conjugate provided herein for treating a non-cancer hyperproliferative disease, a fibrotic disease, an infectious disease, a vasculopathy or Severe Combined Immunodeficiency (SCID) in a subject. Also provided are combinations for use of any of the combinations provided herein for use in treating a non-cancer hyperproliferative disease, a fibrotic disease, an infectious disease, a vasculopathy or Severe Combined Immunodeficiency (SCID). Also provided herein are methods of treating a disease or condition in a subject, that can include administering to the subject any ADA2 protein, for treating a disease or condition that is a non-cancer hyperproliferative disease, a fibrotic disease, an infectious disease, a vasculopathy or Severe Combined Immunodeficiency (SCID). Also provided are medical uses of an ADA2 protein or pharmaceutical compositions for use containing an ADA2 protein for treating a disease or condition that is a non-cancer hyperproliferative disease, a fibrotic disease, an infectious disease, a vasculopathy or Severe Combined Immunodeficiency (SCID). Also provided are combinations for use containing an ADA2 protein and a therapeutic agent for treating a disease or condition that is a non-cancer hyperproliferative disease, a fibrotic disease, an infectious disease, a vasculopathy or Severe Combined Immunodeficiency (SCID)

In some embodiments of methods, uses, pharmaceutical compositions for use or uses provided herein, the ADA2 protein can be a monomer or a dimer. For example, the ADA2 protein can be a dimer, in particular, a homodimer. In some embodiments of methods, uses, pharmaceutical compositions for use or combinations for use provided herein, the ADA2 protein can contain the sequence of amino acids set forth in any of SEQ ID NOS:5, 326-334, 340, 375 or 380-383, a sequence that can exhibit at least 85% sequence identity to the sequence of amino acids set forth in SEQ ID NOS:5, 326-334, 340, 375 or 380-383 or a catalytically active form thereof. For example, the ADA2 protein can contain a sequence of amino acids that can exhibit at least 86%, 87%, 88%, 89%, 90%, 91%, 92%, 93%, 94%, 95%, 96%, 97%, 98%, 99% or more sequence identity to the sequence of amino acids set forth in SEQ ID NOS:5, 326-334, 340, 375 or 380-383 or a catalytically active portion thereof. In particular examples, the ADA2 protein can contain a sequence of amino acids that can exhibit at least 86%, 87%, 88%, 89%, 90%, 91%, 92%, 93%, 94%, 95%, 96%, 97%, 98%, 99% or more sequence identity to the sequence of amino acids set forth in SEQ ID NOS:5 or a catalytically active portion thereof. For example, the ADA2 protein can contain the sequence of amino acids set forth in SEQ ID NO:5.

In some embodiments of methods, uses, pharmaceutical compositions for use, or combinations for use provided herein, the ADA2 protein is a variant ADA2 protein that includes modification(s) in the sequence of amino acids of an unmodified ADA2 polypeptide or a catalytically active portion thereof. In any of such examples, the unmodified ADA2 protein can include the sequence of amino acids set forth in SEQ ID NO:5, or a sequence of amino acids that can exhibit at least 85% sequence identity to the sequence of amino acids set forth in SEQ ID NO:5, or is a catalytically active portion thereof; the amino acid modification(s) are selected from among amino acid replacement(s), deletion(s) and insertion(s); and the variant ADA2 protein, when in dimer form, can exhibit adenosine deaminase activity to convert adenosine to inosine.

In some embodiments of methods, uses, pharmaceutical compositions for use or combinations for use provided herein, the ADA2 protein, when in dimer form, can exhibit a catalytic efficiency ($k_{cat}/K_M$) that is at least or at least about $5\times10^3$ $M^{-1}$ $s^{-1}$, $6\times10^3$ $M^{-1}$ $s^{-1}$, $7\times10^3$ $M^{-1}$ $s^{-1}$, $8\times10^3$ $M^{-1}$ $s^{-1}$, $9\times10^3$ $M^{-1}$ $s^{-1}$, $1\times10^4$ $M^{-1}$ $s^{-1}$, $2\times10^4$ $M^{-1}$ $s^{-1}$, $3\times10^4$ $M^{-1}$ $s^{-1}$, $4\times10^4$ $M^{-1}$ $s^{-1}$, $5\times10^4$ $M^{-1}$ $s^{-1}$, $6\times10^4$ $M^{-1}$ $s^{-1}$, $7\times10^4$ $M^{-1}$ $s^{-1}$, $8\times10^4$ $M^{-1}$ $s^{-1}$, $9\times10^4$ $M^{-1}$ $s^{-1}$, $1\times10^5$ $M^{-1}$ $s^{-1}$, $2\times10^5$ $M^{-1}$ $s^{-1}$, $3\times10^5$ $M^{-1}$ $s^{-1}$, $4\times10^5$ $M^{-1}$ $s^{-1}$, $5\times10^5$ $M^{-1}$ $s^{-1}$ or greater.

In some embodiments of methods, uses, pharmaceutical compositions for use, or combinations for use provided herein, the modification(s) in the sequence of amino acids of an unmodified ADA2 polypeptide can include an amino acid replacement(s); and the variant ADA2 protein can include one or more amino acid replacement(s) at an amino acid position corresponding to amino acid residue 11, 13, 20, 22, 26, 86, 179, 217, 219, 221, 258, 262, 264, 266, 267, 277, 283, 296, 309, 317, 321, 352, 366, 371, 372, 373, 374, 403, 404, 405, 406, 441, 444, 452, 461, 469 or 470, with reference to amino acid positions set forth in SEQ ID NO:5. For example, the variant ADA2 protein can include one or more amino acid replacement selected from among K11A, K11D, K11E, K13A, K13D, K13E, R20A, R20D, R20E, R20N, V22S, K26A, K26D, K26E, D86A, D86C, D86E, D86F, D86G, D86H, D86I, D86K, D86L, D86M, D86N, D86P, D86Q, D86R, D86S, D86T, D86V, D86W, D86Y, E179A, E179C, E179D, E179F, E179G, E179H, E179I, E179K, E179L, E179M, E179N, E179P, E179Q, E179R, E179S, E179T, E179V, E179W, E179Y, R217A, R217D, R217E, R217G, R219A, R219C, R219D, R219E, R219F, R219G, R219H, R219I, R219K, R219L, R219M, R219N, R219P, R219Q, R219S, R219T, R219V, R219W, R219Y, L221A, L221C, L221D, L221E, L221F, L221 G, L221H, L221I, L221K, L221M, L221N, L221P, L221Q, L221R, L221S, L221T, L221V, L221W, L221Y, K258A, K258D, K258E, S262A, S262C, S262D, S262E, S262F, S262G, S262H, S262I, S262K, S262L, S262M, S262N, S262P, S262Q, S262R, S262T, S262V, S262W, S262Y, H264A, H264C, H264D, H264E, H264F, H264G, H264I, H264K, H264L, H264M, H264N, H264P, H264Q, H264R, H654S, H264T, H264V, H264W, H264Y, S266A, S266C, S266D, S266E, S266F, S266G, S266H, S266I, S266K, S266L, S266M, S266N, S266P, S266Q, S266R, S266T, S266V, S266W, S266Y, K267A, K267C, K267D, K267E, K267F, K267G, K267H, K267I, K267L, K267M, K267N, K267P, K267Q, K267R, K267S, K267T, K267V, K267W, K267Y, R277A, R277D, R277E, R283A, R283D, R283E, V296A, V296C, V296D, V296E, V296F, V296G, V296H, V296I, V296K, V296L, V296M, V296N, V296P, V296Q, V296R, V296S, V296T, V296W, V296Y, K309A, K309D, K309E, K317A, K317D, K317E, K321A, K321D, K321E, R352A, R352D, R352E, R366A, R366D, R366E, K371A, K371D, K371E, K371N, K372A, K372D, K372E, K372N, D373S, I374S, T403N, G404N, H405S, P406S, R441A, R441D, R441E, K444A, K444D, K444E, K452A, K452D, K452E, K461A, K461D, K461E, K469A, K469D, K469E, K470A, K470D, and K470E, with reference to amino acid positions set forth in SEQ ID NO:5.

In particular examples, the variant ADA2 protein can include one or more amino acid replacement(s) selected from among K11A, K11E, R20A, R20D, R20E, R219K, R219Q, L221A, L221V, L221G, S262N, H264Q, H264G, R366A, R366D, R366E, K371A, K371D, K371E, K372A, K372D, K372E, K452D and K452E, with reference to amino acid positions set forth in SEQ ID NO:5. In some embodiments of methods, uses, pharmaceutical compositions for use or combinations for use provided herein, the variant ADA2 protein can include amino acid replacements selected from among K11A/R20A, K11A/R20A/K371A, R20A/K371A, K11A/K371A, S262N/K371D, S262N/K371E, S262N/R20E, S262N/R20E/K371D, S262N/R20E/K371E, R219Q/K371E, R219Q/K371D, R219Q/R20E, R219Q/K371E/R20E, R219Q/K371D/R20E, R219Q/S262N/K371E, R219Q/S262N/K371D, R219Q/S262N/R20E, R219Q/S262N/K371E/R20E, R219Q/S262N/K371D/R20E and R219Q/S262N, with reference to amino acid positions set forth in SEQ ID NO:5.

In some embodiments of methods, uses, pharmaceutical compositions for use or combinations for use provided herein, the variant ADA2 protein can include a modification of one or more amino acids in the putative receptor binding (PRB) domain, such as an amino acid deletion, insertion or replacement. For example, the variant ADA2 can include deletion of one or more contiguous amino acid residues corresponding to any one or more contiguous amino acid residues between or between about amino acid residues 98 and 156 or amino acid residues 105 and 148, inclusive, with reference to amino acid positions set forth in SEQ ID NO:5. In any of such examples of methods, uses, pharmaceutical compositions for use or combinations for use provided herein, the variant of ADA2 protein can further include substitution of the deleted region with a peptide linker. For example, the peptide linker is selected from among (Gly)n (SEQ ID NO:368), where n is 2 to 20; (GGGGS)n (SEQ ID NO:343), where n is 1 to 6; (SSSSG)n (SEQ ID NO:344), where n is 1 to 6; (AlaAlaProAla)n (SEQ ID NO:350), where n is 1 to 6; GKSSGSGSESKS (SEQ ID NO:345); GGSTSGSGKSSEGKG (SEQ ID NO:346); GSTSGS-GKSSSEGSGSTKG (SEQ ID NO:347); GSTSGSGKPGS-GEGSTKG (SEQ ID NO:348); and EGKSSGSGSESKEF (SEQ ID NO:349). In particular examples the peptide linker is selected from among GGG (SEQ ID NO:369); GGGGG (SEQ ID NO:360); GGGGGGG (SEQ ID NO:370); GGGGGGGGG (SEQ ID NO:371); and GGGGGGGGGGGGGGG (SEQ ID NO:372). For example, the modification in the PRB domain of the ADA2 protein corresponds to C105-T147del→(Gly) where n is 2 to 20, such as C105-T147del→(Gly)$_{15}$, C105-T147del→(Gly)$_{10}$, C105-T147del→(Gly)$_{7}$, C105-T147del→(Gly)$_{5}$ or C105-T147del→(Gly)$_{3}$, with reference to amino acid positions set forth in SEQ ID NO:5.

In some embodiments of methods, uses, pharmaceutical compositions for use or combinations for use provided herein, the ADA2 protein can be glycosylated at one or more native or non-native glycosylation sites. For example, in some embodiments provided herein containing a variant ADA2 protein, the variant ADA2 protein includes a modification(s) that alters glycosylation by introduction of a non-native glycosylation site. For example, the non-native glycosylation site is introduced by amino acid replacement(s) or insertion of one, two or three amino acids.

In particular examples, the modifications that alter glycosylation are selected from among modifications corresponding to --→N1/--→A2/--→S3, R20N/V22S, K371N/D373S, K372N/I374S, T403N/H405S and G404N/P406S, with reference to amino acid positions set forth in SEQ ID NO:5.

In some embodiments of methods, uses, pharmaceutical compositions for use or combinations for use provided herein, the variant ADA2 can include a polypeptide that has the sequence of amino acids set forth in any of SEQ ID NOS:13-63 or 71-285 or a catalytically active portion thereof.

In some embodiments of methods, uses, pharmaceutical compositions for use or uses provided herein, the subject can be a mammal, in particular a human. In some embodiments of methods provided herein, the pharmaceutical composition can be administered parenterally, locally, or systemically. For example, the pharmaceutical composition can be administered intranasally, intramuscularly, intradermally, intraperitoneally, intravenously, subcutaneously, orally, or by pulmonary administration.

In some embodiments, in the variant ADA2 protein or catalytically active portion thereof provided herein, the variant ADA2 protein in the methods, compositions, conjugates, modified forms, vectors, cells, combinations, uses and compositions for use, and the nucleic acids encoding the variant ADA2 provided herein and vectors that include the nucleic acids, the modifications can be from any one or more of the following amino acid replacement(s), insertion(s), deletion(s), and any combination thereof. The modification(s) listed below are with reference to mature numbering, as set forth in the amino acid positions set forth in SEQ ID NO:5.

Exemplary of ADA2 variants provided herein are the following; it is understood that the different types of mutants (amino acid modifications) can be combined to exploit the properties of each type of mutation. It is understood by those of skill in the art that, in general, the effects of mutations in proteins are at least additive, and can be synergistic.

1. Heparin Binding Mutants

The following modifications can confer reduced heparin binding. Binding to heparin can deplete circulating levels of administered ADA2. Thus, the following ADA2 variants can increase the bioavailability and pharmacokinetics of the administered ADA2:

K11A; K11D; K11E; K13A; K13D; K13E; K371A; K371D; K371E; K372A; K372D; K372E; K452A; K452D; K452E; R20A; R20D; R20E; R366A; R366D; R366E; K26A; K26D; K26E; R217A; R217D; R217E; K258A; K258D; K258E; R277A; R277D; R277E; R283A; R283D; R283E; K309A; K309D; K309E; K317A; K317D; K317E; K321A; K321D; K321E; R352A; R352D; R352E; R441A; R441D; R441E; K444A; K444D; K444E; K461A; K461D; K461E; K469A; K469D; K469E; K470A; K470D; and K470E.

Examples of Heparin Binding Mutants Containing these Replacements:

K11A (SEQ ID NO:13); K11D (SEQ ID NO:14); K11E (SEQ ID NO:15); K13A (SEQ ID NO:16); K13D (SEQ ID NO:17); K13E (SEQ ID NO:18); K371A (SEQ ID NO:19); K371D (SEQ ID NO:20); K371E (SEQ ID NO:21); K372A (SEQ ID NO:22); K372D (SEQ ID NO:23); K372E (SEQ ID NO:24); K452A (SEQ ID NO:25); K452D (SEQ ID NO:26); K452E (SEQ ID NO:27); R20A (SEQ ID NO:28); R20D (SEQ ID NO:29); R20E (SEQ ID NO:30); R366A (SEQ ID NO:31); R366D (SEQ ID NO:32); R366E (SEQ ID NO:33); K26A (SEQ ID NO:71); K26D (SEQ ID NO:72);

K26E (SEQ ID NO:73); R217A (SEQ ID NO:74); R217D (SEQ ID NO:75); R217E (SEQ ID NO:76); K258A (SEQ ID NO:77); K258D (SEQ ID NO:78); K258E (SEQ ID NO:79); R277A (SEQ ID NO:80); R277D (SEQ ID NO:81); R277E (SEQ ID NO:82); R283A (SEQ ID NO:83); R283D (SEQ ID NO:84); R283E (SEQ ID NO:85); K309A (SEQ ID NO:86); K309D (SEQ ID NO:87); K309E (SEQ ID NO:88); K317A (SEQ ID NO:89); K317D (SEQ ID NO:90); K317E (SEQ ID NO:91); K321A (SEQ ID NO:92); K321D (SEQ ID NO:93); K321E (SEQ ID NO:94); R352A (SEQ ID NO:95); R352D (SEQ ID NO:96); R352E (SEQ ID NO:97); R441A (SEQ ID NO:98); R441D (SEQ ID NO:99); R441E (SEQ ID NO:100); K444A (SEQ ID NO:101); K444D (SEQ ID NO:102); K444E (SEQ ID NO:103); K461A (SEQ ID NO:104); K461D (SEQ ID NO:105); K461E (SEQ ID NO:106); K469A (SEQ ID NO:107); K469D (SEQ ID NO:108); K469E (SEQ ID NO:109); K470A (SEQ ID NO:110); K470D (SEQ ID NO:111); and K470E (SEQ ID NO:112).

2. Active Site Mutants

The following modifications can confer increased catalytic efficiency. The modifications are in select residues of the active site, and can effect improved catalytic efficiency ($k_{cat}/K_m$) for adenosine. Binding to heparin can deplete circulating levels of administered ADA2. Thus, the following ADA2 variants can confer increased adenosine deaminase activity:

H264A; H264Q; H264N; H264G; R219K; R219Q; R219N; R219A; L221A; L221V; L221G; E179D; E179A; E179S; E179T; E179V; E179G; S262A; S262V; S262M; S262N; D86A; D86C; D86E; D86F; D86G; D86H; D86I; D86K; D86L; D86M; D86N; D86P; D86Q; D86R; D86S; D86T; D86V; D86W; D86Y; E179C; E179F; E179H; E179I; E179K; E179L; E179M; E179N; E179P; E179Q; E179R; E179W; E179Y; R219C; R219D; R219E; R219F; R219G; R219H; R219I; R219L; R219M; R219P; R219S; R219T; R219V; R219W; R219Y; L221C; L221D; L221E; L221F; L221H; L221I; L221K; L221M; L221N; L221P; L221Q; L221R; L221S; L221T; L221W; L221Y; S262C; S262D; S262E; S262F; S262G; S262H; S262I; S262K; S262L; S262P; S262Q; S262R; S262T; S262W; S262Y; H264C; H264D; H264E; H264F; H264I; H264K; H264L; H264M; H264P; H264R; H264S; H264T; H264V; H264W; H264Y; S266A; S266C; S266D; S266E; S266F; S266G; S266H; S266I; S266K; S266L; S266M; S266N; S266P; S266Q; S266R; S266T; S266V; S266W; S266Y; K267A; K267C; K267D; K267E; K267F; K267G; K267H; K267I; K267L; K267M; K267N; K267P; K267Q; K267R; K267S; K267T; K267V; K267W; K267Y; V296A; V296C; V296D; V296E; V296F; V296G; V296H; V296I; V296K; V296L; V296M; V296N; V296P; V296Q; V296R; V296S; V296T; V296W; and V296Y.

Examples of Active Site Mutants Containing these Replacements:

H264A (SEQ ID NO:34); H264Q (SEQ ID NO:35); H264N (SEQ ID NO:36); H264G (SEQ ID NO:37); R219K (SEQ ID NO:38); R219Q (SEQ ID NO:39); R219N (SEQ ID NO:40); R219A (SEQ ID NO:41); L221A (SEQ ID NO:42); L221V (SEQ ID NO:43); L221G (SEQ ID NO:44); E179D (SEQ ID NO:45); E179A (SEQ ID NO:46); E179S (SEQ ID NO:47); E179T (SEQ ID NO:48); E179V (SEQ ID NO:49); E179G (SEQ ID NO:50); S262A (SEQ ID NO:51); S262V (SEQ ID NO:52); S262M (SEQ ID NO:53); S262N (SEQ ID NO:54); D86A (SEQ ID NO:113); D86C (SEQ ID NO:114); D86E (SEQ ID NO:115); D86F (SEQ ID NO:116); D86G (SEQ ID NO:117); D86H (SEQ ID NO:118); D86I (SEQ ID NO:119); D86K (SEQ ID NO:120); D86L (SEQ ID NO:121); D86M (SEQ ID NO:122); D86N (SEQ ID NO:123); D86P (SEQ ID NO:124); D86Q (SEQ ID NO:125); D86R (SEQ ID NO:126); D86S (SEQ ID NO:127); D86T (SEQ ID NO:128); D86V (SEQ ID NO:129); D86W (SEQ ID NO:130); D86Y (SEQ ID NO:131); E179C (SEQ ID NO:132); E179F (SEQ ID NO:133); E179H (SEQ ID NO:134); E179I (SEQ ID NO:135); E179K (SEQ ID NO:136); E179L (SEQ ID NO:137); E179M (SEQ ID NO:138); E179N (SEQ ID NO:139); E179P (SEQ ID NO:140); E179Q (SEQ ID NO:141); E179R (SEQ ID NO:142); E179W (SEQ ID NO:143); E179Y (SEQ ID NO:144); R219C (SEQ ID NO:145); R219D (SEQ ID NO:146); R219E (SEQ ID NO:147); R219F (SEQ ID NO:148); R219G (SEQ ID NO:149); R219H (SEQ ID NO:150); R219I (SEQ ID NO:151); R219L (SEQ ID NO:152); R219M (SEQ ID NO:153); R219P (SEQ ID NO:154); R219S (SEQ ID NO:155); R219T (SEQ ID NO:156); R219V (SEQ ID NO:157); R219W (SEQ ID NO:158); R219Y (SEQ ID NO:159); L221C (SEQ ID NO:160); L221D (SEQ ID NO:161); L221E (SEQ ID NO:162); L221F (SEQ ID NO:163); L221H (SEQ ID NO:164); L221I (SEQ ID NO:165); L221K (SEQ ID NO:166); L221M (SEQ ID NO:167); L221N (SEQ ID NO:168); L221P (SEQ ID NO:169); L221Q (SEQ ID NO:170); L221R (SEQ ID NO:171); L221S (SEQ ID NO:172); L221T (SEQ ID NO:173); L221W (SEQ ID NO:174); L221Y (SEQ ID NO:175); S262C (SEQ ID NO:176); S262D (SEQ ID NO:177); S262E (SEQ ID NO:178); S262F (SEQ ID NO:179); S262G (SEQ ID NO:180); S262H (SEQ ID NO:181); S262I (SEQ ID NO:182); S262K (SEQ ID NO:183); S262L (SEQ ID NO:184); S262P (SEQ ID NO:185); S262Q (SEQ ID NO:186); S262R (SEQ ID NO:187); S262T (SEQ ID NO:188); S262W (SEQ ID NO:189); S262Y (SEQ ID NO:190); H264C (SEQ ID NO:191); H264D (SEQ ID NO:192); H264E (SEQ ID NO:193); H264F (SEQ ID NO:194); H264I (SEQ ID NO:195); H264K (SEQ ID NO:196); H264L (SEQ ID NO:197); H264M (SEQ ID NO:198); H264P (SEQ ID NO:199); H264R (SEQ ID NO:200); H264S (SEQ ID NO:201); H264T (SEQ ID NO:202); H264V (SEQ ID NO:203); H264W (SEQ ID NO:204); H264Y (SEQ ID NO:205); S266A (SEQ ID NO:206); S266C (SEQ ID NO:207); S266D (SEQ ID NO:208); S266E (SEQ ID NO:209); S266F (SEQ ID NO:210); S266G (SEQ ID NO:211); S266H (SEQ ID NO:212); S266I (SEQ ID NO:213); S266K (SEQ ID NO:214); S266L (SEQ ID NO:215); S266M (SEQ ID NO:216); S266N (SEQ ID NO:217); S266P (SEQ ID NO:218); S266Q (SEQ ID NO:219); S266R (SEQ ID NO:220); S266T (SEQ ID NO:221); S266V (SEQ ID NO:222); S266W (SEQ ID NO:223); S266Y (SEQ ID NO:224); K267A (SEQ ID NO:225); K267C (SEQ ID NO:226); K267D (SEQ ID NO:227); K267E (SEQ ID NO:228); K267F (SEQ ID NO:229); K267G (SEQ ID NO:230); K267H (SEQ ID NO:231); K267I (SEQ ID NO:232); K267L (SEQ ID NO:233); K267M (SEQ ID NO:234); K267N (SEQ ID NO:235); K267P (SEQ ID NO:236); K267Q (SEQ ID NO:237); K267R (SEQ ID NO:238); K267S (SEQ ID NO:239); K267T (SEQ ID NO:240); K267V (SEQ ID NO:241); K267W (SEQ ID NO:242); K267Y (SEQ ID NO:243); V296A (SEQ ID NO:244); V296C (SEQ ID NO:245); V296D (SEQ ID NO:246); V296E (SEQ ID NO:247); V296F (SEQ ID NO:248); V296G (SEQ ID NO:249); V296H (SEQ ID NO:250); V296I (SEQ ID NO:251); V296K (SEQ ID NO:252); V296L (SEQ ID NO:253); V296M (SEQ ID

NO:254); V296N (SEQ ID NO:255); V296P (SEQ ID NO:256); V296Q (SEQ ID NO:257); V296R (SEQ ID NO:258); V296S (SEQ ID NO:259); V296T (SEQ ID NO:260); V296W (SEQ ID NO:261); and V296Y (SEQ ID NO:262).

3. Hyperglycosylation Mutants

The following modifications introduce a non-native glycosylation site in ADA2. Introduction of non-native glycosylation sites, such as N-linked glycosylation sites, can confer an increase in stability and pharmacokinetic profiles. Thus, the following ADA2 variants can effect hyperglycosylation of ADA2, and increase the stability and pharmacokinetic profiles of the administered ADA2:

---→N1/---→A2/---→S3; R20N/V22S; K371N/D373S; K372N/I374S; T403N/H405S; and G404N/P406S.

Examples of Hyperglycosylation Mutants Containing these Replacements:

---→N1/---→A2/---→53 (SEQ ID NO:274); R20N/V22S (SEQ ID NO:275); K371N/D373S (SEQ ID NO:276); K372N/I374S (SEQ ID NO:277); T403N/H405S (SEQ ID NO:278); and G404N/P406S (SEQ ID NO:279).

4. PRB Deletion and Replacement Mutants

The following variants contain a modified PRB domain. The modifications of the PRB domain can include deletion of all or a portion of the PRB domain (i.e. deletion of one or more residues of the PRB domain), insertion of one or more amino acid residues into the PRB domain, amino acid replacement of one or more residues of the PRB domain or a combination thereof. Deletion and/or substitution of the PRB domain can confer altered activity, e.g., reduction in binding to a receptor and/or the activity mediated by the receptor.

C105-T147del→(Gly)n, where n=2 to 20; C105-T147del→(Gly)15; C105-T147del→(Gly)10; C105-T147del→(Gly)7; C105-T147del→(Gly)5; C105-T147del→(Gly)3; N98-N156del; C105-E148del; C105-T147del; V99-Q144del; V99-Q144del→(GGGGS)n, where n=1 to 5; C105-T147del→(GGGGS)n, where n=1 to 5; V99-Q144del→(GGGGS)1; V99-Q144del→(GGGGS)2; V99-Q144del→(GGGGS)3; C105-T147del→(GGGGS)1; C105-T147del→(GGGGS)2; and C105-T147del→(GGGGS)3.

Examples of PRB Deletion and Replacement Mutants Containing these Replacements:

C105-T147del→(Gly)n (SEQ ID NO:280); C105-T147del→(Gly)15 (SEQ ID NO:281); C105-T147del→(Gly)10 (SEQ ID NO:282); C105-T147del→(Gly)7 (SEQ ID NO:283); C105-T147del→(Gly)5 (SEQ ID NO:284); C105-T147del→(Gly)3 (SEQ ID NO:285); N98-N156del (SEQ ID NO:548); C105-E148del (SEQ ID NO:549); C105-T147del (SEQ ID NO:550); V99-Q144del (SEQ ID NO:579); V99-Q144del→(GGGGS)n, where n=1 to 5 (SEQ ID NO:581); C105-T147del→(GGGGS)n, where n=1 to 5 (SEQ ID NO:582); V99-Q144del→(GGGGS)1 (SEQ ID NO:583); V99-Q144del→(GGGGS)2 (SEQ ID NO:584); V99-Q144del→(GGGGS)3 (SEQ ID NO:585); C105-T147del→(GGGGS)1 (SEQ ID NO:586); C105-T147del→(GGGGS)2 (SEQ ID NO:587); and C105-T147del→(GGGGS)3 (SEQ ID NO:588)

5. PRB Hyperglycosylation Mutants

The following modifications can introduce a non-native glycosylation site in the PRB domain. Introduction of non-native glycosylation sites, such as N-linked glycosylation sites, in the PRB domain can confer an increase in stability and pharmacokinetic profiles and/or other activities, e.g., reduction in binding to a receptor. Thus, the following ADA2 variants can effect hyperglycosylation of the ADA2 in the PRB domain, reduce receptor binding, and increase the stability and pharmacokinetic profiles of the administered ADA2:

R125N/P126A; S127N/K129S; P126N/E128T; R112N/I114T; I134N/L135C/L136T; I134N/L135S/L136T; R142N/Q144S; E137N/Y139T; and P111N/G113S.

Examples of PRB Hyperglycosylation Mutants Containing these Replacements:

R125N/P126A (SEQ ID NO:552); S127N/K129S (SEQ ID NO:553); P126N/E128T (SEQ ID NO:554); R112N/I114T (SEQ ID NO:555); I134N/L135C/L136T (SEQ ID NO:556); I134N/L135S/L136T (SEQ ID NO:557); R142N/Q144S (SEQ ID NO:558); E137N/Y139T (SEQ ID NO:559); and P111N/G113S (SEQ ID NO:560).

6. PRB-ADA Domain Interaction Mutants

The following modifications can confer altered interaction between the PRB domain and the rest of ADA2 (e.g., the adenosine deaminase (ADA) domain). Altering the interaction between PRB domain and the rest of ADA2, such as the ADA domain, can confer an activity, e.g., an increase in the adenosine deaminse activity and a reduction in receptor binding:

F119S; F119K; Y224R; Y224N; Y191S; Y191D; F183K; Y191D/Y224R; F109S; F109A; R118D; R118A; Y139T; Y139A; W133S; W133T; P124A; and P124S.

Examples of PRB-ADA Domain Interaction Mutants Containing these Replacements:

F119S (SEQ ID NO:561); F119K (SEQ ID NO:562); Y224R (SEQ ID NO:563); Y224N (SEQ ID NO:564); Y191S (SEQ ID NO:565); Y191D (SEQ ID NO:566); F183K (SEQ ID NO:567); Y191D/Y224R (SEQ ID NO:568); F109S (SEQ ID NO:569); F109A (SEQ ID NO:570); R118D (SEQ ID NO:571); R118A (SEQ ID NO:572); Y139T (SEQ ID NO:573); Y139A (SEQ ID NO:574); W133S (SEQ ID NO:575); W133T (SEQ ID NO:576); P124A (SEQ ID NO:577); and P124S (SEQ ID NO:578).

7. Combinations of Mutations with Hyperglycosylation Mutants

The following variants combine modifications that effect improved catalytic efficiency (kcat/Km) for adenosine, such as R219Q and/or S262N, with modifications that introduce non-native glycosylation sites:

R219Q/S262N/---→N1/---→A2/---→S3; R219Q/S262N/R20N/V22S; R219Q/S262N/K371N/D373S; R219Q/S262N/K372N/I374S; R219Q/S262N/T403N/H405S; and R219Q/S262N/G404N/P406S.

Combination with Hyperglycosylation Mutants Containing these Replacements:

R219Q/S262N/---→N1/---→A2/---→S3 (SEQ ID NO:596); R219Q/S262N/R20N/V22S (SEQ ID NO:597); R219Q/S262N/K371N/D373S (SEQ ID NO:598); R219Q/S262N/K372N/I374S (SEQ ID NO:599); R219Q/S262N/T403N/H405S (SEQ ID NO:600); and R219Q/S262N/G404N/P406S (SEQ ID NO:601).

8. Combinations of Mutations with PRB Hyperglycosylation Mutants

The following variants combine modifications that effect improved catalytic efficiency (kcat/Km) for adenosine, such as R219Q and/or S262N, with modifications that introduce non-native glycosylation sites in the PRB domain:

R219Q/S262N/R125N/P126A; R219Q/S262N/S127N/K129S; R219Q/S262N/P126N/E128T; R219Q/S262N/R112N/I114T; R219Q/S262N/I134N/L135C/L136T; R219Q/S262N/I134N/L135S/L136T; R219Q/S262N/R142N/Q144S; R219Q/S262N/E137N/Y139T; and R219Q/S262N/P111N/G113S.

Examples of Combinations with PRB Hyperglycosylation Mutants Containing these Replacements:

R219Q/S262N/R125N/P126A (SEQ ID NO:607); R219Q/S262N/S127N/K129S (SEQ ID NO:608); R219Q/S262N/P126N/E128T (SEQ ID NO:609); R219Q/S262N/R112N/I114T (SEQ ID NO:610); R219Q/S262N/I134N/L135C/L136T (SEQ ID NO:611); R219Q/S262N/I134N/L135S/L136T (SEQ ID NO:612); R219Q/S262N/R142N/Q144S (SEQ ID NO:613); R219Q/S262N/E137N/Y139T (SEQ ID NO:614); and R219Q/S262N/P111N/G113S (SEQ ID NO:615).

9. Combinations with PRB-ADA Domain Interaction Mutants

The following variants combine modifications that effect improved catalytic efficiency (kcat/Km) for adenosine, such as R219Q and/or S262N, with modifications that alter the interaction between the PRB domain and the rest of ADA2 (e.g., the adenosine deaminase (ADA) domain):

R219Q/S262N/F119S; R219Q/S262N/F119K; R219Q/S262N/Y224R; R219Q/S262N/Y224N; R219Q/S262N/Y191S; R219Q/S262N/Y191D; R219Q/S262N/F183K; R219Q/S262N/Y191D/Y224R; R219Q/S262N/F109S; R219Q/S262N/F109A; R219Q/S262N/R118D; R219Q/S262N/R118A; R219Q/S262N/Y139T; R219Q/S262N/Y139A; R219Q/S262N/W133S; R219Q/S262N/W133T; R219Q/S262N/P124A; and R219Q/S262N/P124S.

Combinations with PRB-ADA Domain Interaction Mutants Containing these Replacements:

R219Q/S262N/F119S (SEQ ID NO:616); R219Q/S262N/F119K (SEQ ID NO:617); R219Q/S262N/Y224R (SEQ ID NO:618); R219Q/S262N/Y224N (SEQ ID NO:619); R219Q/S262N/Y191S (SEQ ID NO:620); R219Q/S262N/Y191D (SEQ ID NO:621); R219Q/S262N/F183K (SEQ ID NO:622); R219Q/S262N/Y191D/Y224R (SEQ ID NO:623); R219Q/S262N/F109S (SEQ ID NO:624); R219Q/S262N/F109A (SEQ ID NO:625); R219Q/S262N/R118D (SEQ ID NO:626); R219Q/S262N/R118A (SEQ ID NO:627); R219Q/S262N/Y139T (SEQ ID NO:628); R219Q/S262N/Y139A (SEQ ID NO:629); R219Q/S262N/W133S (SEQ ID NO:630); R219Q/S262N/W133T (SEQ ID NO:631); R219Q/S262N/P124A (SEQ ID NO:632); and R219Q/S262N/P124S (SEQ ID NO:633).

10. Combinations with PRB Deletion Mutants

The following variants combine modifications that effect improved catalytic efficiency (kcat/Km) for adenosine, such as R219Q and/or S262N, and/or modifications that confer reduced heparin binding, such as K371D, with modifications, e.g., deletions, insertions, substitutions, and/or replacements, in the PRB domain:

K371D/V99-Q144del→(GGGGS)1; K371D/V99-Q144del→(GGGGS)2; K371D/V99-Q144del→(GGGGS)3; K371D/C105-T147del→(GGGGS)1; K371D/C105-T147del→(GGGGS)2; K371D/C105-T147del→(GGGGS)3; R219Q/S262N/C105-T147del→(Gly)15; R219Q/S262N/C105-T147del→(Gly)10; R219Q/S262N/C105-T147del→(Gly)7; R219Q/S262N/C105-T147del→(Gly)5; R219Q/S262N/C105-T147del→(Gly)3; R219Q/S262N/V99-Q144del→(GGGGS)1; R219Q/S262N/V99-Q144del→(GGGGS)2; R219Q/S262N/V99-Q144del→(GGGGS)3; R219Q/S262N/C105-T147del→(GGGGS)1; R219Q/S262N/C105-T147del→(GGGGS)2; R219Q/S262N/C105-T147del→(GGGGS)3; R219Q/S262N/K371D/V99-Q144del→(GGGGS)1; R219Q/S262N/K371D/V99-Q144del→(GGGGS)2; R219Q/S262N/K371D/V99-Q144del→(GGGGS)3; R219Q/S262N/K371D/C105-T147del→(GGGGS)1; R219Q/S262N/K371D/C105-T147del→(GGGGS)2; R219Q/S262N/K371D/C105-T147del→(GGGGS)3; K371D/C105-T147del→(Gly)n, where n=2 to 20; K371D/C105-T147del→(Gly)15; K371D/C105-T147del→(Gly)10; K371D/C105-T147del→(Gly)7; K371D/C105-T147del→(Gly)5; K371D/C105-T147del→(Gly)3; K371D/V99-Q144del→(GGGGS)n, where n=1 to 5; K371D/C105-T147del→(GGGGS)n, where n=1 to 5; K371D/N98-N156del; K371D/C105-E148del; K371D/C105-T147del; K371D/V99-Q144del; R219Q/S262N/C105-T147del→(Gly)n, where n=2 to 20; R219Q/S262N/V99-Q144del→(GGGGS)n, where n=1 to 5; R219Q/S262N/C105-T147del→(GGGGS)n, where n=1 to 5; R219Q/S262N/N98-N156del; R219Q/S262N/C105-E148del; R219Q/S262N/C105-T147del; R219Q/S262N/V99-Q144del; R219Q/S262N/K371D/C105-T147del→(Gly)n, where n=2 to 20; R219Q/S262N/K371D/C105-T147del→(Gly)15; R219Q/S262N/K371D/C105-T147del→(Gly)10; R219Q/S262N/K371D/C105-T147del→(Gly)7; R219Q/S262N/K371D/C105-T147del→(Gly)5; R219Q/S262N/K371D/C105-T147del→(Gly)3; R219Q/S262N/K371D/V99-Q144del→(GGGGS)n, where n=1 to 5; R219Q/S262N/K371D/C105-T147del→(GGGGS)n, where n=1 to 5; R219Q/S262N/K371D/N98-N156del; R219Q/S262N/K371D/C105-E148del; R219Q/S262N/K371D/C105-T147del; R219Q/S262N/K371D/V99-Q144del; R219Q/C105-T147del→(Gly)n, where n=2 to 20; R219Q/V99-Q144del→(GGGGS)n, where n=1 to 5; R219Q/C105-T147del→(GGGGS)n, where n=1 to 5; R219Q/N98-N156del; R219Q/C105-E148del; R219Q/C105-T147del; R219Q/V99-Q144del; S262N/C105-T147del→(Gly)n, where n=2 to 20; S262N/V99-Q144del→(GGGGS)n, where n=1 to 5; S262N/C105-T147del→(GGGGS)n, where n=1 to 5; S262N/N98-N156del; and S262N/C105-E148del; S262N/C105-T147del; and S262N/V99-Q144del.

Examples of Combination with PRB Deletion Mutants Containing these Replacements:

K371D/V99-Q144del→(GGGGS)1 (SEQ ID NO:589); K371D/V99-Q144del→(GGGGS)2 (SEQ ID NO:590); K371D/V99-Q144del→(GGGGS)3 (SEQ ID NO:591); K371D/C105-T147del→(GGGGS)1 (SEQ ID NO:592); K371D/C105-T147del→(GGGGS)2 (SEQ ID NO:593); K371D/C105-T147del→(GGGGS)3 (SEQ ID NO:594); R219Q/S262N/C105-T147del→(Gly)15 (SEQ ID NO:602); R219Q/S262N/C105-T147del→(Gly)10 (SEQ ID NO:603); R219Q/S262N/C105-T147del→(Gly)7 (SEQ ID NO:604); R219Q/S262N/C105-T147del→(Gly)5 (SEQ ID NO:605); R219Q/S262N/C105-T147del→(Gly)3 (SEQ ID NO:606); R219Q/S262N/V99-Q144del→(GGGGS)1 (SEQ ID NO:634); R219Q/S262N/V99-Q144del→(GGGGS)2 (SEQ ID NO:635); R219Q/S262N/V99-Q144del→(GGGGS)3 (SEQ ID NO:636); R219Q/S262N/C105-T147del→(GGGGS)1 (SEQ ID NO:637); R219Q/S262N/C105-T147del→(GGGGS)2 (SEQ ID NO:638); R219Q/S262N/C105-T147del→(GGGGS)3 (SEQ ID NO:639); R219Q/S262N/K371D/V99-Q144del→(GGGGS)1 (SEQ ID NO:640); R219Q/S262N/K371D/V99-Q144del→(GGGGS)2 (SEQ ID NO:641); R219Q/S262N/K371D/V99-Q144del→(GGGGS)3 (SEQ ID NO:642); R219Q/S262N/K371D/C105-T147del→(GGGGS)1 (SEQ ID NO:643); R219Q/S262N/K371D/C105-T147del→(GGGGS)2 (SEQ ID NO:644); R219Q/S262N/K371D/C105-T147del→(GGGGS)3 (SEQ ID NO:645); K371D/C105-T147del→(Gly)n, where n=2 to 20 (SEQ ID NO:646); K371D/C105-T147del→(Gly)15 (SEQ ID NO:647); K371D/C105-T147del→(Gly)10 (SEQ ID NO:648); K371D/C105-T147del→(Gly)7 (SEQ ID NO:649); K371D/C105-T147del→(Gly)5 (SEQ ID NO:650); K371D/C105-T147del→(Gly)3 (SEQ ID NO:651); K371D/V99-Q144del→(GGGGS)n, where n=1 to 5 (SEQ ID NO:652); K371D/C105-T147del→(GGGGS)n, where n=1 to 5 (SEQ ID NO:653); K371D/N98-N156del (SEQ ID NO:654); K371D/C105-E148del (SEQ ID NO:655); K371D/C105-T147del (SEQ ID NO:656); K371D/V99-Q144del (SEQ ID NO:657); R219Q/S262N/C105-T147del→(Gly)n, where n=2 to 20 (SEQ ID NO:658); R219Q/S262N/V99-Q144del→(GGGGS)n, where n=1 to 5 (SEQ ID NO:664); R219Q/S262N/C105-T147del→(GGGGS)n, where n=1 to 5 (SEQ ID NO:665); R219Q/S262N/N98-N156del (SEQ ID NO:666); R219Q/S262N/C105-E148del (SEQ ID NO:667); R219Q/S262N/C105-T147del (SEQ ID NO:668); R219Q/S262N/V99-Q144del (SEQ ID NO:669); R219Q/S262N/K371D/C105-T147del→(Gly)n, where n=2 to 20 (SEQ ID NO:670); R219Q/S262N/K371D/C105-T147del→(Gly)15 (SEQ ID NO:671); R219Q/S262N/K371D/C105-T147del→(Gly)10 (SEQ ID NO:672); R219Q/S262N/K371D/C105-T147del→(Gly)7 (SEQ ID NO:673); R219Q/S262N/K371D/C105-T147del→(Gly)5 (SEQ ID NO:674); R219Q/S262N/K371D/C105-T147del→(Gly)3 (SEQ ID NO:675); R219Q/S262N/K371D/V99-Q144del→(GGGGS)n, where n=1 to 5 (SEQ ID NO:676); R219Q/S262N/K371D/C105-T147del→(GGGGS)n, where n=1 to 5 (SEQ ID NO:677); R219Q/S262N/K371D/N98-N156del (SEQ ID NO:678); R219Q/S262N/K371D/C105-E148del (SEQ ID NO:679); R219Q/S262N/K371D/C105-T147del (SEQ ID NO:680); R219Q/S262N/K371D/V99-Q144del (SEQ ID NO:681); R219Q/C105-T147del→(Gly)n, where n=2 to 20 (SEQ ID NO:918); R219Q/V99-Q144del→(GGGGS)n, where n=1 to 5 (SEQ ID NO:919); R219Q/C105-T147del→(GGGGS)n, where n=1 to 5 (SEQ ID NO:920); R219Q/N98-N156del (SEQ ID NO:921); R219Q/C105-E148del (SEQ ID NO:922); R219Q/C105-T147del (SEQ ID NO:923); R219Q/V99-Q144del (SEQ ID NO:924); S262N/C105-T147del→(Gly)n, where n=2 to 20 (SEQ ID NO:925); S262N/V99-Q144del→(GGGGS)n, where n=1 to 5 (SEQ ID NO:926); S262N/C105-T147del→(GGGGS)n, where n=1 to 5 (SEQ ID NO:927); S262N/N98-N156del (SEQ ID NO:928); S262N/C105-E148del (SEQ ID NO:929); S262N/C105-T147del (SEQ ID NO:930); and S262N/V99-Q144del (SEQ ID NO:931).

11. Other Combination Mutants

The following variants combine various modifications, such as modifications that effect improved catalytic efficiency (kcat/Km) for adenosine, such as R219Q and/or S262N, modifications that confer reduced heparin binding, such as K371D, and other modifications:

K11A/R20A; K11A/R20A/K371A; R20A/K371A; K11A/K371A; S262N/K371D; S262N/K371E; S262N/R20E; S262N/R20E/K371D; S262N/R20E/K371E; R219Q/K371E; R219Q/K371D; R219Q/R20E; R219Q/K371E/R20E; R219Q/K371D/R20E; R219Q/S262N/K371E; R219Q/S262N/K371D; R219Q/S262N/R20E; R219Q/S262N/K371E/R20E; R219Q/S262N/K371D/R20E; R219Q/S262N; R219Q/S262N/K11A; R219Q/S262N/K11D; R219Q/S262N/K11E; R219Q/S262N/K13A; R219Q/S262N/K13D; R219Q/S262N/K13E; R219Q/S262N/K371A; R219Q/S262N/K372A; R219Q/S262N/K372D; R219Q/S262N/K372E; R219Q/S262N/K452A; R219Q/S262N/K452D; R219Q/S262N/K452E; R219Q/S262N/R20A; R219Q/S262N/R20D; R219Q/S262N/R366A; R219Q/S262N/R366D; R219Q/S262N/R366E; R219Q/S262N/H264A; R219Q/S262N/H264Q; R219Q/S262N/H264N; R219Q/S262N/H264G; R219K/S262N; R219N/S262N; R219A/S262N; R219Q/S262N/L221A; R219Q/S262N/L221V; R219Q/S262N/L221G; R219Q/S262N/E179D; R219Q/S262N/E179A; R219Q/S262N/E179S; R219Q/S262N/E179T; R219Q/S262N/E179V; R219Q/S262N/E179G; R219Q/S262A; R219Q/S262V; R219Q/S262M; R219Q/S262N/K11A/R20A; R219Q/S262N/K11A/R20A/K371A; R219Q/S262N/R20A/K371A; R219Q/S262N/K11A/K371A; R219Q/S262N/K26A; R219Q/S262N/K26D; R219Q/S262N/K26E; R219Q/S262N/R217A; R219Q/S262N/R217D; R219Q/S262N/R217E; R219Q/S262N/K258A; R219Q/S262N/K258D; R219Q/S262N/K258E; R219Q/S262N/R277A; R219Q/S262N/R277D; R219Q/S262N/R277E; R219Q/S262N/R283A; R219Q/S262N/R283D; R219Q/S262N/R283E; R219Q/S262N/K309A; R219Q/S262N/K309D; R219Q/S262N/K309E; R219Q/S262N/K317A; R219Q/S262N/K317D; R219Q/S262N/K317E; R219Q/S262N/K321A; R219Q/S262N/K321D; R219Q/S262N/K321E; R219Q/S262N/R352A; R219Q/S262N/R352D; R219Q/S262N/R352E; R219Q/S262N/R441A; R219Q/S262N/R441D; R219Q/S262N/R441E; R219Q/S262N/K444A; R219Q/S262N/K444D; R219Q/S262N/K444E; R219Q/S262N/K461A; R219Q/S262N/K461D; R219Q/S262N/K461E; R219Q/S262N/K469A; R219Q/S262N/K469D; R219Q/S262N/K469E; R219Q/S262N/K470A; R219Q/S262N/K470D; R219Q/S262N/K470E; R219Q/S262N/D86A; R219Q/S262N/D86C; R219Q/S262N/D86E; R219Q/S262N/D86F; R219Q/S262N/D86G; R219Q/S262N/D86H; R219Q/S262N/D86I; R219Q/S262N/D86K; R219Q/S262N/D86L; R219Q/S262N/D86M; R219Q/S262N/D86N; R219Q/S262N/D86P; R219Q/S262N/D86Q; R219Q/S262N/D86R; R219Q/S262N/D86S; R219Q/S262N/D86T; R219Q/S262N/D86V; R219Q/S262N/D86W; R219Q/S262N/D86Y; R219Q/S262N/E179C; R219Q/S262N/E179F; R219Q/S262N/E179H; R219Q/S262N/E179I; R219Q/S262N/E179K; R219Q/S262N/E179L; R219Q/S262N/E179M; R219Q/S262N/E179N; R219Q/S262N/E179P; R219Q/S262N/E179Q; R219Q/S262N/E179R; R219Q/S262N/E179W; R219Q/S262N/E179Y; R219C/S262N; R219D/S262N; R219E/S262N; R219F/S262N; R219G/S262N; R219H/S262N; R219I/S262N; R219L/S262N; R219M/S262N; R219P/S262N; R219S/S262N; R219T/S262N; R219V/S262N; R219W/S262N; R219Y/S262N; R219Q/S262N/L221C; R219Q/S262N/L221D; R219Q/S262N/L221E; R219Q/S262N/L221F; R219Q/S262N/L221H; R219Q/S262N/L221I; R219Q/S262N/L221K; R219Q/S262N/L221M; R219Q/S262N/L221N; R219Q/S262N/L221P; R219Q/S262N/L221Q; R219Q/S262N/L221R; R219Q/S262N/L221S; R219Q/S262N/L221T; R219Q/S262N/L221W; R219Q/S262N/L221Y; R219Q/S262C; R219Q/S262D; R219Q/S262E; R219Q/S262F; R219Q/S262G; R219Q/S262H; R219Q/S262I; R219Q/S262K; R219Q/S262L; R219Q/S262P; R219Q/S262Q; R219Q/S262R; R219Q/S262T; R219Q/S262W; R219Q/S262Y; R219Q/S262N/H264C; R219Q/S262N/H264D; R219Q/S262N/H264E; R219Q/S262N/H264F; R219Q/S262N/H264I; R219Q/S262N/H264K; R219Q/S262N/H264L; R219Q/S262N/H264M; R219Q/S262N/H264P; R219Q/S262N/H264R; R219Q/S262N/H264S; R219Q/S262N/H264T; R219Q/S262N/H264V; R219Q/S262N/H264W; R219Q/S262N/H264Y; R219Q/S262N/S266A; R219Q/S262N/S266C; R219Q/S262N/S266D; R219Q/S262N/S266E; R219Q/S262N/S266F; R219Q/S262N/S266G; R219Q/S262N/S266H; R219Q/S262N/S266I; R219Q/S262N/S266K; R219Q/S262N/S266L; R219Q/S262N/S266M; R219Q/S262N/S266N; R219Q/S262N/S266P; R219Q/S262N/S266Q; R219Q/S262N/S266R; R219Q/S262N/S266T; R219Q/

S262N/S266V; R219Q/S262N/S266W; R219Q/S262N/S266Y; R219Q/S262N/K267A; R219Q/S262N/K267C; R219Q/S262N/K267D; R219Q/S262N/K267E; R219Q/S262N/K267F; R219Q/S262N/K267G; R219Q/S262N/K267H; R219Q/S262N/K267I; R219Q/S262N/K267L; R219Q/S262N/K267M; R219Q/S262N/K267N; R219Q/S262N/K267P; R219Q/S262N/K267Q; R219Q/S262N/K267R; R219Q/S262N/K267S; R219Q/S262N/K267T; R219Q/S262N/K267V; R219Q/S262N/K267W; R219Q/S262N/K267Y; R219Q/S262N/V296A; R219Q/S262N/V296C; R219Q/S262N/V296D; R219Q/S262N/V296E; R219Q/S262N/V296F; R219Q/S262N/V296G; R219Q/S262N/V296H; R219Q/S262N/V296I; R219Q/S262N/V296K; R219Q/S262N/V296L; R219Q/S262N/V296M; R219Q/S262N/V296N; R219Q/S262N/V296P; R219Q/S262N/V296Q; R219Q/S262N/V296R; R219Q/S262N/V296S; R219Q/S262N/V296T; R219Q/S262N/V296W; R219Q/S262N/V296Y; R219Q/K11A/R20A; R219Q/K11A/R20A/K371A; R219Q/R20A/K371A; R219Q/K11A/K371A; S262N/K11A/R20A; S262N/K11A/R20A/K371A; S262N/R20A/K371A; and S262N/K11A/K371A.

Examples of these Combination Mutants Containing these Replacements:

K11A/R20A (SEQ ID NO:55); K11A/R20A/K371A (SEQ ID NO:56); R20A/K371A (SEQ ID NO:57); K11A/K371A (SEQ ID NO:58); S262N/K371D (SEQ ID NO:59); S262N/K371E (SEQ ID NO:60); S262N/R20E (SEQ ID NO:61); S262N/R20E/K371D (SEQ ID NO:62); S262N/R20E/K371E (SEQ ID NO:63); R219Q/K371E (SEQ ID NO:263); R219Q/K371D (SEQ ID NO:264); R219Q/R20E (SEQ ID NO:265); R219Q/K371E/R20E (SEQ ID NO:266); R219Q/K371D/R20E (SEQ ID NO:267); R219Q/S262N/K371E (SEQ ID NO:268); R219Q/S262N/K371D (SEQ ID NO:269); R219Q/S262N/R20E (SEQ ID NO:270); R219Q/S262N/K371E/R20E (SEQ ID NO:271); R219Q/S262N/K371D/R20E (SEQ ID NO:272); R219Q/S262N (SEQ ID NO:273); R219Q/S262N/K11A (SEQ ID NO:659); R219Q/S262N/K11D (SEQ ID NO:660); R219Q/S262N/K11E (SEQ ID NO:661); R219Q/S262N/K13A (SEQ ID NO:662); R219Q/S262N/K13D (SEQ ID NO:663); R219Q/S262N/K13E (SEQ ID NO:682); R219Q/S262N/K371A (SEQ ID NO:683); R219Q/S262N/K372A (SEQ ID NO:684); R219Q/S262N/K372D (SEQ ID NO:685); R219Q/S262N/K372E (SEQ ID NO:686); R219Q/S262N/K452A (SEQ ID NO:687); R219Q/S262N/K452D (SEQ ID NO:688); R219Q/S262N/K452E (SEQ ID NO:689); R219Q/S262N/R20A (SEQ ID NO:690); R219Q/S262N/R20D (SEQ ID NO:691); R219Q/S262N/R366A (SEQ ID NO:692); R219Q/S262N/R366D (SEQ ID NO:693); R219Q/S262N/R366E (SEQ ID NO:694); R219Q/S262N/H264A (SEQ ID NO:695); R219Q/S262N/H264Q (SEQ ID NO:696); R219Q/S262N/H264N (SEQ ID NO:697); R219Q/S262N/H264G (SEQ ID NO:698); R219K/S262N (SEQ ID NO:699); R219N/S262N (SEQ ID NO:700); R219A/S262N (SEQ ID NO:701); R219Q/S262N/L221A (SEQ ID NO:702); R219Q/S262N/L221V (SEQ ID NO:703); R219Q/S262N/L221G (SEQ ID NO:704); R219Q/S262N/E179D (SEQ ID NO:705); R219Q/S262N/E179A (SEQ ID NO:706); R219Q/S262N/E179S (SEQ ID NO:707); R219Q/S262N/E179T (SEQ ID NO:708); R219Q/S262N/E179V (SEQ ID NO:709); R219Q/S262N/E179G (SEQ ID NO:710); R219Q/S262A (SEQ ID NO:711); R219Q/S262V (SEQ ID NO:712); R219Q/S262M (SEQ ID NO:713); R219Q/S262N/K11A/R20A (SEQ ID NO:714); R219Q/S262N/K11A/R20A/K371A (SEQ ID NO:715); R219Q/S262N/R20A/K371A (SEQ ID NO:716); R219Q/S262N/K11A/K371A (SEQ ID NO:717); R219Q/S262N/K26A (SEQ ID NO:718); R219Q/S262N/K26D (SEQ ID NO:719); R219Q/S262N/K26E (SEQ ID NO:720); R219Q/S262N/R217A (SEQ ID NO:721); R219Q/S262N/R217D (SEQ ID NO:722); R219Q/S262N/R217E (SEQ ID NO:723); R219Q/S262N/K258A (SEQ ID NO:724); R219Q/S262N/K258D (SEQ ID NO:725); R219Q/S262N/K258E (SEQ ID NO:726); R219Q/S262N/R277A (SEQ ID NO:727); R219Q/S262N/R277D (SEQ ID NO:728); R219Q/S262N/R277E (SEQ ID NO:729); R219Q/S262N/R283A (SEQ ID NO:730); R219Q/S262N/R283D (SEQ ID NO:731); R219Q/S262N/R283E (SEQ ID NO:732); R219Q/S262N/K309A (SEQ ID NO:733); R219Q/S262N/K309D (SEQ ID NO:734); R219Q/S262N/K309E (SEQ ID NO:735); R219Q/S262N/K317A (SEQ ID NO:736); R219Q/S262N/K317D (SEQ ID NO:737); R219Q/S262N/K317E (SEQ ID NO:738); R219Q/S262N/K321A (SEQ ID NO:739); R219Q/S262N/K321D (SEQ ID NO:740); R219Q/S262N/K321E (SEQ ID NO:741); R219Q/S262N/R352A (SEQ ID NO:742); R219Q/S262N/R352D (SEQ ID NO:743); R219Q/S262N/R352E (SEQ ID NO:744); R219Q/S262N/R441A (SEQ ID NO:745); R219Q/S262N/R441D (SEQ ID NO:746); R219Q/S262N/R441E (SEQ ID NO:747); R219Q/S262N/K444A (SEQ ID NO:748); R219Q/S262N/K444D (SEQ ID NO:749); R219Q/S262N/K444E (SEQ ID NO:750); R219Q/S262N/K461A (SEQ ID NO:751); R219Q/S262N/K461D (SEQ ID NO:752); R219Q/S262N/K461E (SEQ ID NO:753); R219Q/S262N/K469A (SEQ ID NO:754); R219Q/S262N/K469D (SEQ ID NO:755); R219Q/S262N/K469E (SEQ ID NO:756); R219Q/S262N/K470A (SEQ ID NO:757); R219Q/S262N/K470D (SEQ ID NO:758); R219Q/S262N/K470E (SEQ ID NO:759); R219Q/S262N/D86A (SEQ ID NO:760); R219Q/S262N/D86C (SEQ ID NO:761); R219Q/S262N/D86E (SEQ ID NO:762); R219Q/S262N/D86F (SEQ ID NO:763); R219Q/S262N/D86G (SEQ ID NO:764); R219Q/S262N/D86H (SEQ ID NO:765); R219Q/S262N/D86I (SEQ ID NO:766); R219Q/S262N/D86K (SEQ ID NO:767); R219Q/S262N/D86L (SEQ ID NO:768); R219Q/S262N/D86M (SEQ ID NO:769); R219Q/S262N/D86N (SEQ ID NO:770); R219Q/S262N/D86P (SEQ ID NO:771); R219Q/S262N/D86Q (SEQ ID NO:772); R219Q/S262N/D86R (SEQ ID NO:773); R219Q/S262N/D86S (SEQ ID NO:774); R219Q/S262N/D86T (SEQ ID NO:775); R219Q/S262N/D86V (SEQ ID NO:776); R219Q/S262N/D86W (SEQ ID NO:777); R219Q/S262N/D86Y (SEQ ID NO:778); R219Q/S262N/E179C (SEQ ID NO:779); R219Q/S262N/E179F (SEQ ID NO:780); R219Q/S262N/E179H (SEQ ID NO:781); R219Q/S262N/E179I (SEQ ID NO:782); R219Q/S262N/E179K (SEQ ID NO:783); R219Q/S262N/E179L (SEQ ID NO:784); R219Q/S262N/E179M (SEQ ID NO:785); R219Q/S262N/E179N (SEQ ID NO:786); R219Q/S262N/E179P (SEQ ID NO:787); R219Q/S262N/E179Q (SEQ ID NO:788); R219Q/S262N/E179R (SEQ ID NO:789); R219Q/S262N/E179W (SEQ ID NO:790); R219Q/S262N/E179Y (SEQ ID NO:791); R219C/S262N (SEQ ID NO:792); R219D/S262N (SEQ ID NO:793); R219E/S262N (SEQ ID NO:794); R219F/S262N (SEQ ID NO:795); R219G/S262N (SEQ ID NO:796); R219H/S262N (SEQ ID NO:797); R219I/S262N (SEQ ID NO:798); R219L/S262N (SEQ ID NO:799); R219M/S262N (SEQ ID NO:800); R219P/S262N (SEQ ID NO:801); R219S/S262N (SEQ ID NO:802); R219T/S262N (SEQ ID NO:803); R219V/S262N (SEQ ID NO:804); R219W/S262N (SEQ ID NO:805); R219Y/S262N (SEQ ID NO:806); R219Q/S262N/L221C (SEQ ID NO:807); R219Q/S262N/L221D (SEQ ID NO:808); R219Q/S262N/L221E (SEQ ID NO:809); R219Q/S262N/L221F (SEQ ID NO:810); R219Q/

S262N/L221H (SEQ ID NO:811); R219Q/S262N/L221I (SEQ ID NO:812); R219Q/S262N/L221K (SEQ ID NO:813); R219Q/S262N/L221M (SEQ ID NO:814); R219Q/S262N/L221N (SEQ ID NO:815); R219Q/S262N/L221P (SEQ ID NO:816); R219Q/S262N/L221Q (SEQ ID NO:817); R219Q/S262N/L221R (SEQ ID NO:818); R219Q/S262N/L221S (SEQ ID NO:819); R219Q/S262N/L221T (SEQ ID NO:820); R219Q/S262N/L221W (SEQ ID NO:821); R219Q/S262N/L221Y (SEQ ID NO:822); R219Q/S262C (SEQ ID NO:823); R219Q/S262D (SEQ ID NO:824); R219Q/S262E (SEQ ID NO:825); R219Q/S262F (SEQ ID NO:826); R219Q/S262G (SEQ ID NO:827); R219Q/S262H (SEQ ID NO:828); R219Q/S262I (SEQ ID NO:829); R219Q/S262K (SEQ ID NO:830); R219Q/S262L (SEQ ID NO:831); R219Q/S262P (SEQ ID NO:832); R219Q/S262Q (SEQ ID NO:833); R219Q/S262R (SEQ ID NO:834); R219Q/S262T (SEQ ID NO:835); R219Q/S262W (SEQ ID NO:836); R219Q/S262Y (SEQ ID NO:837); R219Q/S262N/H264C (SEQ ID NO:838); R219Q/S262N/H264D (SEQ ID NO:839); R219Q/S262N/H264E (SEQ ID NO:840); R219Q/S262N/H264F (SEQ ID NO:841); R219Q/S262N/H264I (SEQ ID NO:842); R219Q/S262N/H264K (SEQ ID NO:843); R219Q/S262N/H264L (SEQ ID NO:844); R219Q/S262N/H264M (SEQ ID NO:845); R219Q/S262N/H264P (SEQ ID NO:846); R219Q/S262N/H264R (SEQ ID NO:847); R219Q/S262N/H264S (SEQ ID NO:848); R219Q/S262N/H264T (SEQ ID NO:849); R219Q/S262N/H264V (SEQ ID NO:850); R219Q/S262N/H264W (SEQ ID NO:851); R219Q/S262N/H264Y (SEQ ID NO:852); R219Q/S262N/S266A (SEQ ID NO:853); R219Q/S262N/S266C (SEQ ID NO:854); R219Q/S262N/S266D (SEQ ID NO:855); R219Q/S262N/S266E (SEQ ID NO:856); R219Q/S262N/S266F (SEQ ID NO:857); R219Q/S262N/S266G (SEQ ID NO:858); R219Q/S262N/S266H (SEQ ID NO:859); R219Q/S262N/S266I (SEQ ID NO:860); R219Q/S262N/S266K (SEQ ID NO:861); R219Q/S262N/S266L (SEQ ID NO:862); R219Q/S262N/S266M (SEQ ID NO:863); R219Q/S262N/S266N (SEQ ID NO:864); R219Q/S262N/S266P (SEQ ID NO:865); R219Q/S262N/S266Q (SEQ ID NO:866); R219Q/S262N/S266R (SEQ ID NO:867); R219Q/S262N/S266T (SEQ ID NO:868); R219Q/S262N/S266V (SEQ ID NO:869); R219Q/S262N/S266W (SEQ ID NO:870); R219Q/S262N/S266Y (SEQ ID NO:871); R219Q/S262N/K267A (SEQ ID NO:872); R219Q/S262N/K267C (SEQ ID NO:873); R219Q/S262N/K267D (SEQ ID NO:874); R219Q/S262N/K267E (SEQ ID NO:875); R219Q/S262N/K267F (SEQ ID NO:876); R219Q/S262N/K267G (SEQ ID NO:877); R219Q/S262N/K267H (SEQ ID NO:878); R219Q/S262N/K267I (SEQ ID NO:879); R219Q/S262N/K267L (SEQ ID NO:880); R219Q/S262N/K267M (SEQ ID NO:881); R219Q/S262N/K267N (SEQ ID NO:882); R219Q/S262N/K267P (SEQ ID NO:883); R219Q/S262N/K267Q (SEQ ID NO:884); R219Q/S262N/K267R (SEQ ID NO:885); R219Q/S262N/K267S (SEQ ID NO:886); R219Q/S262N/K267T (SEQ ID NO:887); R219Q/S262N/K267V (SEQ ID NO:888); R219Q/S262N/K267W (SEQ ID NO:889); R219Q/S262N/K267Y (SEQ ID NO:890); R219Q/S262N/V296A (SEQ ID NO:891); R219Q/S262N/V296C (SEQ ID NO:892); R219Q/S262N/V296D (SEQ ID NO:893); R219Q/S262N/V296E (SEQ ID NO:894); R219Q/S262N/V296F (SEQ ID NO:895); R219Q/S262N/V296G (SEQ ID NO:896); R219Q/S262N/V296H (SEQ ID NO:897); R219Q/S262N/V296I (SEQ ID NO:898); R219Q/S262N/V296K (SEQ ID NO:899); R219Q/S262N/V296L (SEQ ID NO:900); R219Q/S262N/V296M (SEQ ID NO:901); R219Q/S262N/V296N (SEQ ID NO:902); R219Q/S262N/V296P (SEQ ID NO:903); R219Q/S262N/V296Q (SEQ ID NO:904); R219Q/S262N/V296R (SEQ ID NO:905); R219Q/S262N/V296S (SEQ ID NO:906); R219Q/S262N/V296T (SEQ ID NO:907); R219Q/S262N/V296W (SEQ ID NO:908); R219Q/S262N/V296Y (SEQ ID NO:909); R219Q/K11A/R20A (SEQ ID NO:910); R219Q/K11A/R20A/K371A (SEQ ID NO:911); R219Q/R20A/K371A (SEQ ID NO:912); R219Q/K11A/K371A (SEQ ID NO:913); S262N/K11A/R20A (SEQ ID NO:914); S262N/K11A/R20A/K371A (SEQ ID NO:915); S262N/R20A/K371A (SEQ ID NO:916); and S262N/K11A/K371A (SEQ ID NO:917).

BRIEF DESCRIPTION OF THE FIGURES

FIGS. 1A-1F depict exemplary alignments of precursor human adenosine deaminase 2 (ADA2) set forth in SEQ ID NO:2 (residues 30-511 corresponding to mature ADA2 set forth in SEQ ID NO:5) with other ADA2 proteins. A "*" means that the aligned residues are identical, a ":" means that aligned residues are not identical, but are similar and contain conservative amino acids residues at the aligned position, and a "." means that the aligned residues are similar and contain semi-conservative amino acid residues at the aligned position. Residues corresponding to the putative receptor binding domain (PRB) are underlined. Exemplary, non-limiting, corresponding positions for amino acid replacements are indicated by highlighting. For example, FIG. 1A depicts the alignment of ADA2 set forth in SEQ ID NO:2 with chimpanzee ADA2 set forth in SEQ ID NO:286. FIG. 1B depicts the alignment of a ADA2 set forth in SEQ ID NO:2 with gorilla ADA2 set forth in SEQ ID NO:287. FIG. 1C depicts the alignment of a ADA2 set forth in SEQ ID NO:2 with pygmy chimpanzee set forth in SEQ ID NO:288. FIG. 1D depicts the alignment of ADA2 set forth in SEQ ID NO:2 with Sumatran orangutan ADA2 set forth in SEQ ID NO:289. FIG. 1E depicts the alignment of ADA2 set forth in SEQ ID NO:2 with northern white-cheeked gibbon ADA2 set forth in SEQ ID NO:290. FIG. 1F depicts the alignment of ADA2 set forth in SEQ ID NO:2 with crab-eating macaque ADA2 set forth in SEQ ID NO:291.

DETAILED DESCRIPTION

Figure 2:
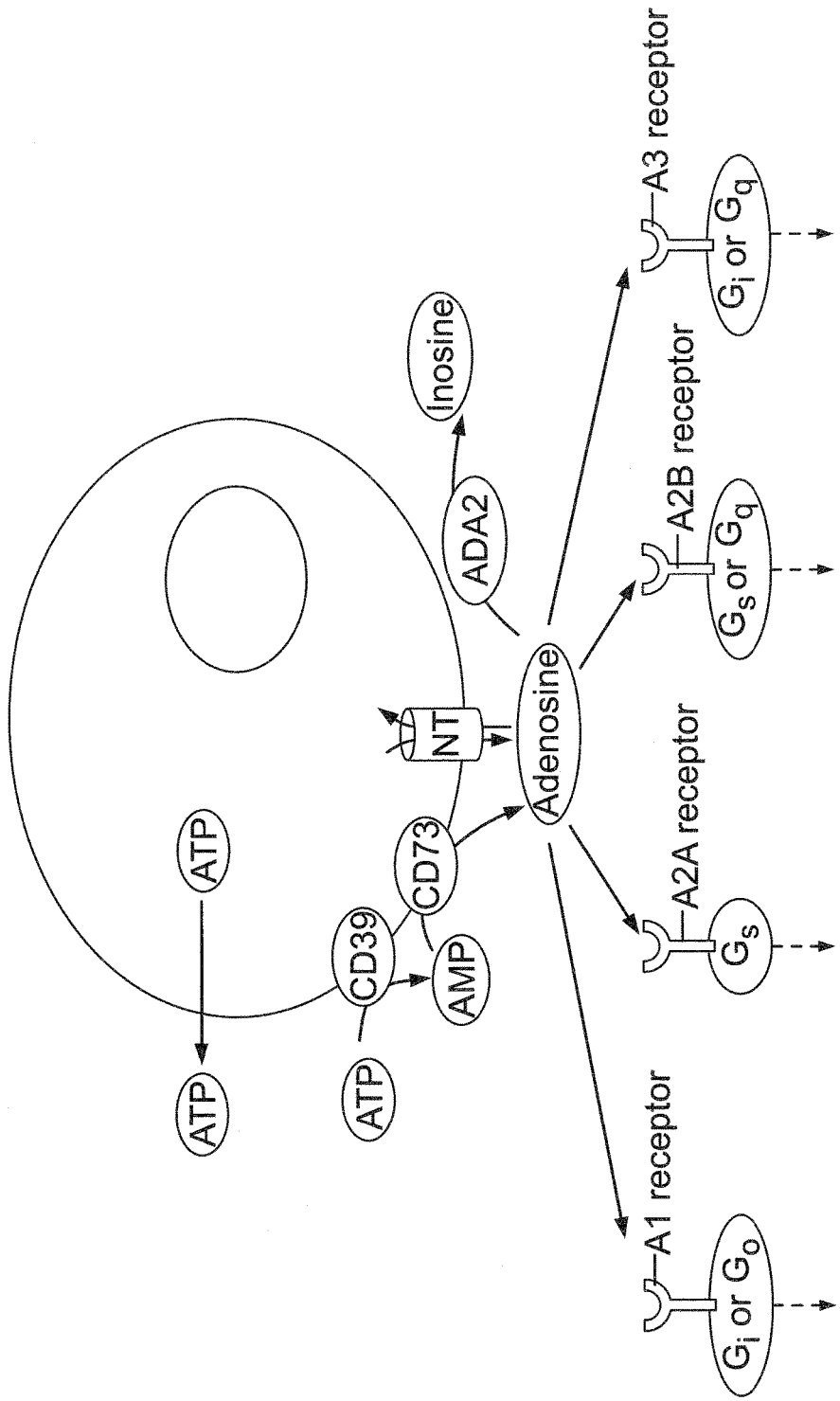
FIG. 2 depicts the biosynthesis and catabolism of extracellular adenosine, and adenosine receptor signaling (adapted from Antonioli et al. (2013) Nat Rev Can 13:842-857). Physiological conditions such as hypoxia, ischemia, inflammation, tumor environment or trauma can promote the extracellular accumulation of ATP, which is metabolized to AMP by the cell surface enzyme CD39. AMP is in turn metabolized to adenosine by CD73. Extracellular adenosine can bind to four different G-protein-coupled adenosine receptors (ADRs; i.e. A1, A2A, A2B and A3), expressed on the cell surface of nearby immune, tumor or other cells, to mediate various downstream adenosine-mediated signaling and activities, such as immunosuppression, cancer cell proliferation, cancer cell migration and/or metastasis, angiogenesis, and other effects. Nucleoside transporters (NTs) facilitate uptake of extracellular adenosine into cells. Adenosine deaminase 2 (ADA2), including exogenous ADA2 or variants as provided herein, can breakdown extracellular adenosine by catalyzing the conversion of adenosine to inosine.

Outline
- A. Definitions
- B. Adenosine Deaminase 2 (ADA2) and Modulation of Adenosine-Mediated
  Tumor Immunosuppression
  1. Tumor Immunity and Immune Evasion
  2. Adenosine Immunomodulation in Cancer and Tumor Microenvironment (TME)
  3. Adenosine Deaminase and Targeting Adenosine in Treatment of Cancer
- C. Adenosine Deaminase 2 (ADA2) and Variants Thereof
  1. Structure and Activity of ADA2
     a. Structure of ADA2
     b. Activities of ADA2
  2. ADA2 Variants
     a. Exemplary Modifications
        i. Amino Acid Replacements
        ii. Modification(s) of PRB Domain
        iv. Hyperglycosylation
     b. Nucleic Acid Molecules
     c. Production of Variant ADA2 Proteins
- D. ADA2 Conjugates and Fusion Proteins
  1. Half-Life Extending Moieties
     a. Low Complexity Polypeptides
     b. C-terminal peptide (CTP) of the β Subunit of Human Chorionic Gonadotropin
     c. Immunoglobulin Constant Region (Fc) or Portions Thereof
     d. Albumin or Fragment, or Variant Thereof
     e. Albumin Binding Moiety
     f. PAS Sequences
     g. HAP Sequences
     h. XTEN Sequences
     i. Transferrin or Fragment thereof
     j. Polymer conjugation
        i. Polyethylene Glycol (PEG)
        ii. Hydroxyethyl Starch (HES)
        iii. Polysialic Acids (PSA)
        iv. Other polymers
  2. Methods of Producing Conjugates or Fusion Proteins
     Linkers
        i. Peptide Linkers
        ii. Heterobifunctional linking agents
- E. Methods of Producing Nucleic Acids Encoding ADA2 and Polypeptides Thereof
  1. Isolation or Preparation of Nucleic Acids Encoding ADA2 Polypeptides
  2. Generation of Mutant or Modified Nucleic Acid and Encoding Polypeptides
  3. Vectors and Cells Immune cells that encode and express the ADA2 variants provided herein
  4. Expression
     a. Prokaryotic Cells
     b. Yeast Cells
     c. Insect Cells
     d. Mammalian Cells
     e. Plants
  5. Purification Techniques
- F. Methods of Assessing Activity and Physical Properties of ADA2
  1. Adenosine Deaminase Assay
  2. Methods of Assessing Heparin Binding
     a. Affinity Assay
     b. ELISA Assay
     c. Dot Blot and other Radiolabeled Heparin Binding Assays
  3. Methods for Assessing Stability
     a. Conditions
        i. Stability in Plasma
        ii. Thermal Stability
        iii. Stability in pH or pH Optima
        iv. Other Conditions
     b. Determination of Physical Properties
        i. Enzymatic Activity
        ii. Chromatographic Analysis of Protein Purity
        iii. Differential Scanning calorimetry
        iv. Differential Scanning Fluorimetry
        v. Intrinsic Fluorescence Spectroscopy
        vi. Circular Dichroism
        vii. Dynamic Light Scattering
        viii. Static Light Scattering
        ix. Turbidity Measurements
        x. Other Methods to Determine Stability
  4. Assay for Therapeutic Activity
     a. In vitro Tests
     b. In vivo Animal Models
        i. Tumor Metabolic Activity
        ii. Tumor Size and Volume
     c. Clinical Monitoring
  5. Pharmacodynamics/Pharmacokinetics and Tolerability
- G. Pharmaceutical Compositions and Formulations
  1. Formulations—liquids, injectables, emulsions
     Lyophilized Powders
  2. Compositions for Other Routes of Administration
  3. Dosages and Administration
  4. Packaging and Articles of Manufacture
- H. Methods of Treatment with an Adenosine Deaminase 2 (ADA2)
  1. Exemplary Diseases and Conditions
     a. Cancers and Tumors
     b. Non-Cancer Hyperproliferative Diseases
     c. Fibrotic Diseases
     d. Infectious Diseases
     e. Other Diseases and Conditions
  2. Methods of Patient Selection
     a. Adenosine-associated Biomarkers
        i. Plasma Adenosine Levels
        ii. Adenosine Receptors (ADRs)
        iii. Ectonucleotidases CD39 and CD73
     b. Patient Selection
  3. Dosages and Administration
  4. Combination Therapies
     a. Anticancer Agents
        i. Anticancer Antibodies
        ii. Chemotherapeutic Agents
        iii. Radiation Therapy
        iv. Anti-angiogenic Agents
        v. Immune Checkpoint Inhibitors
           (a) Anti-CTLA4 Therapies
           (b) Anti-PD-1 and Anti-PD-L1 Therapies
     b. Other Immunomodulatory Agents
     c. Hyaluronan-Degrading Enzyme Soluble hyaluronan degrading enzymes (e.g. soluble PH20)
  d. Antibodies to Treat Infectious Diseases
  e. Antibiotics and Antifungals
I. Examples

A. DEFINITIONS

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "adenosine" refers to a purine nucleoside that is composed of a molecule of adenine attached to a ribose sugar molecule (ribofuranose) moiety via a β-$N_9$-glycosidic bond. Adenosine can modulate a variety of physiological processes through its interaction with adenosine receptors.

As used herein, "Michaelis constant" or $K_m$ is a measure of the substrate concentration required for effective catalysis to occur. For example, an enzyme with a high $K_m$ can require a higher substrate concentration to achieve a given reaction velocity than an enzyme with a lower $K_m$ for the substrate. $K_m$ can represent the affinity of the enzyme for a substrate.

As used herein, "catalytic efficiency" is the efficiency with which an enzyme reacts with a substrate to form a product. It is represented by the $k_{cat}/K_m$ ($M^{-1} s^{-1}$ or 1/Ms). Methods to assess kinetic parameters of catalytic activity, including $k_{cat}/K_m$, are well known to a skilled artisan. Generally, $k_{cat}/K_m$ is measured under steady state conditions.

As used herein, "adenosine deaminase" or "ADA" refers to an enzyme that catalyzes the hydrolytic deamination of adenosine to form inosine. An ADA also can deaminate 2'deoxyadenosine to 2'deoxyinosine, and hence includes enzymes that have 2'deoxyadenosine deaminase activity. In humans there are two ADA isozymes, designated ADA1 and ADA2, that differ in their molecular weight, catalytic parameters and other properties.

As used herein, "adenosine deaminase 1" or ADA1 refers to an ADA that lacks a signal peptide and is ubiquitously expressed inside cells. It is produced as a monomer. Exemplary of ADA1 is human ADA1 having the sequence of nucleotides set forth in SEQ ID NO:11 and encoding the sequence of amino acids set forth in SEQ ID NO:12. In humans, wild-type ADA1 is characterized by a Km of or of about $5.2 \times 10^{-5}$ M, has a pH optimum of from or from about 7 to 7.5, and exhibits a similar affinity for both adenosine and 2'deoxyadenosine. For example, ADA1 has a 2'deoxyadenosine/adenosine deaminase ratio of at least or at least about 0.70, such at least or at least about 0.75. Reference to ADA1 includes wild-type or native ADA1 present in mammalian, including human and non-human, subjects. For example, reference to ADA1 includes human ADA1 that contains a polypeptide having the sequence of amino acids set forth in SEQ ID NO:12. Reference to ADA1 also includes variants thereof, such as allelic variants, species variants, splice variants and other variants that include a polypeptide having a sequence of amino acids that has at least 65%, 70%, 75%, 80%, 85%, 85%, 87%, 88%, 89%, 90%, 91%, 92%, 93%, 94%, 95%, 96%, 97%, 98%, 99% or more sequence identity to SEQ ID NO:12, and that exhibit adenosine deaminase activity.

As used herein, "adenosine deaminase 2," or "ADA2" refers to an ADA that is present in extracellular environments, including in the plasma. ADA2 is produced from a precursor polypeptide that contains a signal peptide (e.g. ADA2 set forth in SEQ ID NO:2), which is removed to yield a mature protein lacking the signal peptide (e.g. ADA2 set forth in SEQ ID NO:5). The secreted ADA2 is a homodimer containing two identical polypeptide chains that interact via non-polar interactions between residues of each subunit. In humans, wild-type ADA2 is characterized with a Km that is or is about $200 \times 10^{-5}$ M, has a pH optimum of or of about 6.5±0.2, and exhibits a weak affinity for 2'deoxyadenosine. For example, ADA2 has a 2'deoxyadenosine/adenosine deaminase ratio of less than 0.40, such less than or about 0.30 or less than or about 0.25. Reference to ADA2 includes wild-type or native ADA2 present in mammalian, including human and non-human, subjects. For example, reference to ADA2 includes human ADA2 that contains a polypeptide having the sequence of amino acids set forth in SEQ ID NO:2, the mature form set forth in SEQ ID NO:5, catalytically active portions of SEQ ID NO:5, and dimer forms thereof. Reference to ADA2 also includes precursor, mature, catalytically active forms, and dimer forms that are variants thereof, such as allelic variants, species variants, splice variants and other variants that include a polypeptide having a sequence of amino acids that has at least 40%, 50%, 60%, 65%, 70%, 75%, 80%, 85%, 85%, 87%, 88%, 89%, 90%, 91%, 92%, 93%, 94%, 95%, 96%, 97%, 98%, 99% or more sequence identity to the precursor polypeptide set forth in SEQ ID NO:2 or the mature form thereof set forth in SEQ ID NO:5, and that, when in active form, exhibit adenosine deaminase activity. Such variants, when in active form, exhibit at least 40%, 50%, 70%, 90%, 90%, 100%, 110%, 120%, 130%, 140%, 150%, 160%, 170%, 180%, 190%, 200% 300%, 400%, 500%, 600%, 700%, 800%, 900%, 1000% or more activity than the activity of a native or wildtype ADA2 polypeptide. As used herein, wild-type" or "native" with reference to ADA2 refers to a ADA2 protein containing a polypeptide encoded by a native or naturally occurring ADA2 gene, including allelic variants, that is present in an organism, including a human and other animals, in nature. Reference to wild-type ADA2 without reference to a species is intended to encompass any species of a wild-type ADA2. Included among wild-type ADA2 polypeptides are the encoded precursor polypeptide, fragments thereof, and processed forms thereof, such as a mature form lacking the signal peptide, as well as any pre- or post-translationally processed or modified forms thereof. Also included among native ADA2 proteins are those that are post-translationally modified, including, but not limited to, modification by glycosylation, carboxylation and hydroxylation. Native ADA2 proteins also include the polypeptide monomer as well as dimer forms. For example, humans express native ADA2. Wild-type human ADA2 is set forth in SEQ ID NO:2 (precursor) and SEQ ID NO:5 (mature), and includes catalytically active forms thereof as described herein, and allelic variants (precursor or mature) set forth in any of SEQ ID NOS:376-383, or isoforms of an ADA2 such as ADA2 set forth in SEQ ID NO:68. Wildtype or native ADA2 from non-human species include, but are not limited to, ADA2 from *Pan troglodytes* (chimpanzee;

precursor form SEQ ID NO:286, mature form SEQ ID NO:326; NCBI Acc. No. XP_003317127.1); *Gorilla gorilla* (gorilla; precursor form SEQ ID NO:287, mature form SEQ ID NO:327; NCBI Acc. No. XP_004063024.1); *Pan paniscus* (pygmy chimpanzee; precursor form SEQ ID NO:288, mature form SEQ ID NO:328; NCBI Acc. No. XP_003828345.1); *Pongo abelii* (Sumatran orangutan; precursor form SEQ ID NO:289, mature form SEQ ID NO:329; NCBI Acc. No. NP_001125360.1); *Nomascus leucogenys* (Northern white-cheeked gibbon; precursor form SEQ ID NO:290, mature form SEQ ID NO:330; NCBI Acc. No. XP_004088517.1); *Macaca fascicularis* (crab-eating macaque; precursor form SEQ ID NO:291, mature form SEQ ID NO:331; NCBI Acc. No. XP_005568111.1); *Chlorocebus sabaeus* (green monkey; precursor form SEQ ID NO:292, mature form SEQ ID NO:332; NCBI Acc. No. XP_007972990.1); *Macaca mulatta* (Rhesus macaque; precursor form SEQ ID NOS:293, 337, mature form SEQ ID NOS:333, 340; GenBank Acc. Nos. AFH32795.1, EHH20002.1); *Callithrix jacchus* (marmoset; precursor form SEQ ID NOS:294, 374, mature form SEQ ID NO:334, 375; NCBI Acc. No. XP_009004591.1, XP_009004586.1); *Xenopus laevis* (African clawed frog; precursor form SEQ ID NO:295, mature form SEQ ID NO:335; NCBI Acc. No. NP_001090531.1); *Drosophila melanogaster* (fruit fly; precursor form SEQ ID NOS:296-300, mature form SEQ ID NOS:336, 338, 339; AAL40913.1, AAL40920.1, AAL40911.1, AAL40912.1, and AAL40910.1); *Bombyx mori* (silk moth; precursor form SEQ ID NO:301, mature form SEQ ID NO:341; NCBI Acc. No. NP 001098698.1); and *Sarcophaga perigrina* (flesh fly; precursor form SEQ ID NO:302, mature form SEQ ID NO:342; GenBank Acc. No. BAA11812.1).

As used herein, a precursor ADA2 refers to a non-secreted form of an ADA2 that contains an N-terminal signal peptide that targets the protein for secretion. The signal peptide is cleaved off in the endoplasmic reticulum. Exemplary of an ADA2 precursor polypeptide is the polypeptide set forth in SEQ ID NO:2, or an allelic or species variant or other variant thereof such as those set forth in any of SEQ ID NOS:286-302, 337 or 376-379.

As used herein, a "mature ADA2" refers to an ADA2 that lacks a signal sequence. An exemplary mature ADA2 is set forth in SEQ ID NO:5, and also includes variants thereof such as species and allelic variants and other variants, such as those set forth in any of SEQ ID NOS:326-336, 338-342, 375, and 380-383. Reference to mature ADA2 includes dimer forms thereof.

As used herein, species variants refer to variants in polypeptides among different species, including different mammalian species, such as mouse and human.

As used herein, allelic variants refer to variations in proteins among members of the same species.

As used herein, domain (typically a sequence of three or more, generally 5 or 7 or more amino acids) refers to a portion of a molecule, such as proteins or the encoding nucleic acids, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as proteolytic activity. A protein can have one, or more than one, distinct domains. For example, a domain can be identified, defined or distinguished by homology of the sequence therein to related family members, such as homology to motifs that define a protease domain. In another example, a domain can be distinguished by its function, such as by proteolytic activity, or an ability to interact with a biomolecule, such as DNA binding, ligand binding, and dimerization. A domain independently can exhibit a biological function or activity such that the domain independently or fused to another molecule can perform an activity, such as, for example proteolytic activity or ligand binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

As used herein "catalytic domain" or "ADA domain" refers to the domain that confers adenosine deaminase activity. The catalytic domain of an enzyme contains all of the requisite properties of that protein required for its enzymatic, such as adenosine deaminase activity. The ADA domain is structurally composed of an eight-stranded, parallel β-sheet that closes into a barrel and is surrounded by classical α/β-TIM barrel motif helices and five additional, located between β1 and α1 (H1, H2, and H3) and at the C terminus (H4 and H5) (Zavialov et al. (2010) J. Biol. Chem. 285:12367-12377). Loops between β-strands and α-helices contain many of the active site residues required for activity. Active site residues include residues that coordinate zinc binding, active site proton donor and acceptor residues, and substrate binding residues. Exemplary of such residues in human ADA2 are set forth in Table 4. In reference to human ADA2, the ADA domain is contained in the region corresponding to residues 106-502 of the precursor sequence of amino acids set forth in SEQ ID NO:2 (corresponding to residues 77-473 of the mature protein set forth in SEQ ID NO:5), except that residues corresponding to the putative receptor binding (PRB) domain contained therein are not required for catalytic activity.

As used herein, "a catalytically active portion thereof" or "a catalytically active fragment thereof" refers to an ADA2 polypeptide that contains less than the full-length sequence of a mature ADA2 polypeptide, but contains a contiguous portion of amino acids of an ADA2, including all or part of the catalytic domain, sufficient for adenosine deaminase activity. For example, a catalytically active portion of ADA2 is one that includes a polypeptide containing a contiguous sequence of amino acids of the mature sequence of an ADA2 polypeptide that includes amino acid residues corresponding to residues 83, 85, 327, 330, 355, and 412 with reference to amino acid residues set forth in SEQ ID NO:5, but does not include the full amino acid sequence of the mature ADA2 polypeptide. For example, a catalytically active portion is one that includes a polypeptide containing a contiguous sequence of amino acids of the mature sequence of ADA2 set forth in SEQ ID NO:5 that includes amino acid residues 83, 85, 327, 330, 355, and 412, but that does not include the full length sequence of amino acids set forth in SEQ ID NO:5. An ADA2 that contains a catalytically active portion of an ADA2 polypeptide, when in active form, exhibits at least 1%, 2%, 3%, 4%, 5%, 6%, 7%, 8%, 9%, 10%, 20%, 30%, 40%, 50%, 60%, 70%, 80%, 90%, or more of the activity, such as at least 120%, 130%, 140%, 150%, 200%, 300%, 400%, 500% or more of the activity, compared to the ADA2 containing a full-length mature ADA2 polypeptide. In one example, a catalytically active portion of an ADA2 polypeptide includes a polypeptide that lacks all or a portion of the putative receptor binding (PRB) domain. In another example, a catalytically active portion of an ADA2 polypeptide includes a polypeptide that lacks one or more C-terminal amino acids of the mature polypeptide, i.e. is truncated at the C-terminus, by up to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more contiguous C-terminal amino acid residues compared to the mature ADA2 polypeptide. It is understood that reference herein to a variant ADA2 or catalytically active portion thereof means that the catalytically active portion contains the modification(s) (e.g. amino acid replacement(s)).

As used herein, "putative receptor binding domain" or "PRB domain" refers to a portion of ADA2 that forms an independently folded structure composed of an α- and β-fold containing a three-stranded antiparallel β-sheets designated SR1-SR2-SR3, surrounded by the HR and partially H2 α-helices on one side and the proline-rich SR2-SR3 loop on the other side (Zavialov et al. (2010) J. Biol. Chem. 285:12367-12377). The PRB domain contains conserved cysteine residues that form a disulfide bond between C137 and C159 of precursor ADA2 set forth in SEQ ID NO:2 (positions C108 and C130 of mature ADA2 set forth in SEQ ID NO:5). The PRB domain is reported to be involved in binding of ADA2 to its receptors. It is understood that the particular residues that make up the domain can vary (e.g. longer or shorter), for example, depending on methods used to identify the domain. In reference to human ADA2, the PRB domain is reported to correspond to residues 127-185 or 134-177 of precursor ADA2 set forth in SEQ ID NO:2 (residues 98-156 or 105-148, respectively, of mature ADA2 set forth in SEQ ID NO:5).

As used herein, a protein lacking all or a portion of a domain, such as all or a portion of the PRB domain, refers a polypeptide that has a deletion of one or more amino acids or all of the amino acids of the domain, such as the PRB domain, compared to a reference or unmodified protein. Amino acids deleted in a polypeptide lacking all or part of a domain can be contiguous, but need not be contiguous amino acids within the domain of the cognate polypeptide. Polypeptides that lack all or a part of a domain can include the loss or reduction of an activity of the polypeptide compared to the activity of a reference or unmodified protein.

As used herein, "active form" refers to any ADA2 enzyme that exhibits adenosine deaminase activity. An active form of an enzyme can contain a full-length sequence of amino acids or can be a catalytically active portion thereof. An active form of an enzyme can be a monomer or a dimer. Typically, an active enzyme is a dimer. An active enzyme is any form that exhibits a catalytic efficiency ($k_{cat}/K_M$) that is at least or at least about $5\times10^3$ $M^{-1}$ $s^{-1}$, $6\times10^3$ $M^{-1}$ $s^{-1}$, $7\times10^3$ $M^{-1}$ $s^{-1}$, $8\times10^3 M^{-1}$ $s^{-1}$, $9\times10^3$ $M^{-1}$ $s^{-1}$, $1\times10^4$ $M^{-1}$ $s^{-1}$, $2\times10^4$ $M^{-1}$ $s^{-1}$, $3\times10^4$ $M^{-1}$ $s^{-1}$, $4\times10^4$ $M^{-1}$ $s^{-1}$, $5\times10^4$ $M^{-1}$ $s^{-1}$, $6\times10^4$ $M^{-1}$ $s^{-1}$, $7\times10^4$ $M^{-1}$ $s^{-1}$, $8\times10^4$ $M^{-1}$ $s^{-1}$, $9\times10^4$ $M^{-1}$ $s^{-1}$, $1\times10^5$ $M^{-1}$ $s^{-1}$, $2\times10^5$ $M^{-1}$ $s^{-1}$, $3\times10^5$ $M^{-1}$ $s^{-1}$, $4\times10^5 M^{-1} s^{-1}$, $5\times10^5 M^{-1} s^{-1}$, $6\times10^5 M^{-1} s^{-1}$, $7\times10^5 M^{-1} s^{-1}$, $8\times10^5 M^{-1} s^{-1}$, $9\times10^5 M^{-1} s^{-1}$, $1\times10^6 M^{-1} s^{-1}$, $2\times10^6 M^{-1} s^{-1}$, $3\times10^6 M^{-1} s^{-1}$, $4\times10^6 M^{-1} s^{-1}$, $5\times10^6 M^{-1} s^{-1}$ or greater.

As used herein, a "multimer" refers to a molecule composed of several identical or different subunits held together or associated, for example, by non-covalent interactions.

As used herein, a "dimer" refers to a molecule that contains two polypeptides linked together. Typically, the polypeptides are non-covalently linked. For example, an ADA2 dimer is formed by nonpolar intersubunit interactions, including hydrophobic interaction, between residues of two polypeptides.

As used herein, a "homodimer" refers to a dimer that is formed by two identical polypeptides.

As used herein, a "heterodimer" refers to a dimer that is formed by two different polypeptides.

As used herein, a "monomer" refers to a single protein or polypeptide unit. A monomer has a relatively low molecular weight compared to dimers or other multimers. A monomer can exist independently, or it can associate with other molecules to form a dimer or other multimer.

As used herein a "corresponding form" with reference to an ADA2 protein means that when comparing a property or activity of two ADA2 proteins, the property is compared using the same structural form of the protein. For example, if its stated that an ADA2 protein has less activity compared to the activity of the corresponding form of a first ADA2 protein, that means that a particular form, such as a dimer, has less activity compared to the dimer of the first ADA2 protein.

As used herein, a "polypeptide" refers to a linear organic polymer containing a large number of amino acid residues bonded together in a chain, forming part of, or the whole of, a protein molecule.

As used herein, a "protein" or "protein molecule" or variations thereof refers to a large molecule composed of one or more polypeptide chains made up of a linear sequence of amino acids. Hence, a protein can be a monomer, or can be a dimer or other multimer. A protein can exhibit structural, mechanical, biochemical or signaling activities.

As used herein, a "polypeptide subunit" or "protein subunit" refers to a single polypeptide or monomer that is capable of assembling with other polypeptides or monomers to form a protein molecule that is a multimeric complex. One subunit is made up of one polypeptide chain.

As used herein, "variant ADA2 protein" refers to an ADA2 protein, including any form thereof such as a full-length, catalytically active portion, monomer, or dimer, that has one or more amino acid differences compared to an unmodified ADA2 protein. The one or more amino acid differences can be amino acid mutations, such as one or more amino acid replacements (substitutions), insertions or deletions, or can be insertions or deletions of entire domains, and any combination thereof. Typically, a variant ADA2 protein has one or more modifications in primary sequence compared to an unmodified ADA2 protein. For example, a variant ADA2 provided herein can have at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85 or more amino acid differences compared to an unmodified ADA2 protein. Any modification is contemplated as long as the resulting protein exhibits adenosine deaminase activity.

As used herein, modification refers to modification of a sequence of amino acid residues of a polypeptide or a sequence of nucleotides in a nucleic acid molecule and includes deletions, insertions, and replacements of amino acids and nucleotides, respectively. Modifications also can include post-translational modifications or other changes to the molecule that can occur due to conjugation or linkage, directly or indirectly, to another moiety. Methods of modifying a polypeptide are routine to those of skill in the art, such as by using recombinant DNA methodologies.

As used herein, "deletion," when referring to modification of a nucleic acid or polypeptide sequence, refers to the removal of one or more nucleotides or amino acids compared to a sequence, such as a target polynucleotide or polypeptide or a native or wild-type sequence. Thus, an amino acid sequence or nucleic acid molecule that contains one or more deletions compared to a wild-type sequence, contains one or more fewer amino acids or nucleotides within the linear length of the sequence.

As used herein, "insertion" when referring to modification of a nucleic acid or amino acid sequence, describes the inclusion of one or more additional nucleotides or amino acids, within a target, native, wild-type or other related sequence. Thus, an amino acid or nucleic acid molecule that contains one or more insertions compared to a wild-type sequence, contains one or more additional amino acids or nucleotides within the linear length of the sequence.

As used herein, "additions" to nucleic acid and amino acid sequences describe addition of nucleotides or amino acids onto either termini compared to another sequence.

As used herein, "substitution" or "replacement" with respect to a modification refers to the replacing of one or more nucleotides or amino acids in a native, target, wild-type or other nucleic acid or polypeptide sequence with an alternative nucleotide or amino acid, without changing the length (as described in numbers of residues) of the molecule. Thus, one or more substitutions in a molecule does not change the number of amino acid residues or nucleotides of the molecule. Amino acid replacements compared to a particular polypeptide can be expressed in terms of the number of the amino acid residue along the length of the polypeptide sequence or a reference polypeptide sequence. For example, a modified polypeptide having a modification in the amino acid at the 19$^{th}$ position of the amino acid sequence that is a substitution of Isoleucine (Ile; I) for cysteine (Cys; C) can be expressed as "replacement with Cys or C at a position corresponding to position 19," I19C, Ile19Cys, or simply C19, to indicate that the amino acid at the modified 19$^{th}$ position is a cysteine. In this example, the molecule having the substitution has a modification at Ile 19 of the unmodified polypeptide.

As used herein, "unmodified polypeptide" or "unmodified ADA2" and grammatical variations thereof refer to a starting polypeptide that is selected for modification as provided herein. The starting polypeptide can be a naturally-occurring, wild-type form of a polypeptide. Exemplary of an unmodified ADA2 polypeptide is human ADA2 set forth in SEQ ID NO:5, or a catalytically active portion thereof. In addition, the starting polypeptide can be altered or mutated, such that it differs from a native wild type isoform but is nonetheless referred to herein as a starting unmodified polypeptide relative to the subsequently modified polypeptides produced herein. Thus, existing proteins known in the art that have been modified to have a desired increase or decrease in a particular activity or property compared to an unmodified reference protein can be selected and used as the starting unmodified polypeptide. For example, a protein that has been modified from its native form by one or more single amino acid changes and possesses either an increase or decrease in a desired property, such as a change in an amino acid residue or residues to alter glycosylation, can be a target protein, referred to herein as unmodified, for further modification of either the same or a different property.

As used herein, "corresponding residues" refers to residues that occur at aligned loci. For purposes herein, the amino acid sequence of a protein is aligned to precursor ADA2 set forth in SEQ ID NO:2 or its mature form set forth in SEQ ID NO:5 (see FIG. 1) or to the ADA2 sequence used for Zavialov numbering, the numbering of residues used in Zavialov et al. (2010) J. Biol. Chem. 285:12367-12377 and in PDB accession Nos. 3LGG and 3LGD, set forth in SEQ ID NO:4. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of ADA2 polypeptides, one of skill in the art can identify corresponding residues, using conserved and identical amino acid residues as guides. Generally, recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm.

As used herein, a "property" of an ADA2 refers to a physical or structural property, such as three-dimensional structure, pI, half-life, conformation and other such physical characteristics.

As used herein, an "activity" of an ADA2 or "ADA2 activity" refers to any activity exhibited by the active form of an ADA2 protein, typically the dimer form. Such activities can be tested in vitro and/or in vivo and include, but are not limited to, adenosine deaminase activity, growth factor activity, ability to bind heparin and/or ability to bind to an adenosine receptor (ADR). Activity can be assessed in vitro or in vivo using recognized assays, for example, by measuring adenosine deaminase activity in vitro or in vivo. The results of such assays indicate that a polypeptide exhibits an activity that can be correlated to activity of the polypeptide in vivo, in which in vivo activity can be referred to as biological activity. Assays to determine functionality or activity of modified forms of ADA2 are known to those of skill in the art, and exemplary assays are described herein.

As used herein, "adenosine deaminase activity" refers to the ability of an enzyme to catalyze the hydrolytic deamination of adenosine to form inosine. ADA2 activity can be assessed, directly or indirectly, by measuring the rate of production of a product of the enzymatic reaction. For example, the production of inosine or ammonia can be directly or indirectly measured. In other examples, the decrease of the substrate of the enzyme, e.g., adenosine or 2-deoxyadenosine, is measured. Assays to assess adenosine deaminase activity are known to those of skill in the art, and include but are not limited to, assays in which the decrease of the substrate, or the increase of the product, is measured directly by spectrophotometry, or indirectly, by subsequent enzymatic or oxidation-reduction reactions that use chromogenic substrates or change the absorbance spectra of the reaction.

As used herein, "increased adenosine deaminase activity" refers to an enhanced ability of an ADA2 protein, for example a variant ADA2 protein, to exhibit adenosine deaminase activity as compared with a reference protein. For example, the ability of a variant ADA2 protein to exhibit adenosine deaminase activity can be greater than the adenosine deaminase activity of the unmodified ADA2 protein. The adenosine deaminase activity can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, 600%, 700%, 800%, 900%, 1000%, or more compared to the adenosine deaminase activity of reference or an unmodified protein.

As used herein, a glycosylation site refers to an amino position in a polypeptide to which a carbohydrate moiety can be attached. Typically, a glycosylated protein contains one or more amino acid residues, such as asparagine or serine, for the attachment of the carbohydrate moieties.

As used herein, a native glycosylation site refers to an amino position to which a carbohydrate moiety is attached in a wild-type polypeptide. There are four N-linked native glycosylation sites in ADA2 corresponding to residues N98, N145, N156 and N349 with reference to SEQ ID NO:5.

As used herein, a non-native glycosylation site refers to an amino position to which a carbohydrate moiety is attached in a modified polypeptide that is not present in a wild-type polypeptide. Non-native glycosylation sites can be introduced into a ADA2 polypeptide by amino acid replacement. O-glycosylation sites can be created, for example, by amino acid replacement of a native residue with a serine or threonine. N-glycosylation sites can be created, for example, by establishing the motif Asn-Xaa-Ser/Thr/Cys, where Xaa is not proline. Creation of this consensus sequence by amino acid modification can involve, for example, a single amino acid replacement of a native amino acid residue with an asparagine, a single amino acid replacement of a native amino acid residue with a serine, threonine or cysteine, or a double amino acid replacement involving a first amino acid replacement of a native residue with an asparagine and a second amino acid replacement of native residue with a serine, threonine or cysteine, or an insertion of a non-native N-glycosylation motif, such as the motif Asn-Xaa-Ser/Thr/Cys, where Xaa is not proline.

As used herein, "level of glycosylation" refers to the number of glycosylation sites capable of being occupied by a glycan, for example, upon expression in a host cell capable of glycosylation.

As used herein, increases with reference to the level of glycosylation means that there is a greater number of glycosylation sites capable of being occupied by a glycan with reference to an unmodified or wildtype ADA2. A variant ADA2 that exhibits an increased level of glycosylation can be hyperglycosylated if there is a greater number of glycosylation sites occupied by a glycan compared to the unmodified or wildtype ADA2.

As used herein, "protein stability" refers to a measure of the maintenance of one or more physical properties of a protein in response to an environmental condition (e.g. an elevated temperature). In one embodiment, the physical property is the maintenance of the covalent structure of the protein (e.g. the absence of proteolytic cleavage, unwanted oxidation or deamidation). In another embodiment, the physical property is the presence of the protein in a properly folded state (e.g. the absence of soluble or insoluble aggregates or precipitates). In one embodiment, stability of a protein is measured by assaying a biophysical property of the protein, for example thermal stability, pH unfolding profile, stable removal of glycosylation, solubility, biochemical function (e.g., ability to bind to a protein such as a receptor or enzymatic activity) and/or combinations thereof. In another embodiment, biochemical function is demonstrated by the binding affinity of an interaction. Stability can be measured using methods known in the art and/or described herein.

As used herein, "half-life" refers to the time that a living body requires to eliminate one half of the quantity of an administered substance through its normal channels of elimination. The normal channels of elimination generally include the kidneys and liver, but can include other excretion pathways. A half-life can be described as the time it takes the concentration of a substance to halve its concentration from steady state or from a certain point on the elimination curve. A half-life typically is measured in the plasma and can be determined by giving a single dose of drug, and then measuring the concentration of the drug in the plasma at times to determine the relationship between time and decline in concentration as the substance is eliminated.

As used herein, "increased half-life" refers to a longer half-life of a protein molecule compared to a reference protein. Hence, it means that the time that it takes the concentration of a substance to halve its concentration is longer than for the time it takes the concentration of a reference protein to halve. The half-life can be increased by at least 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, 600%, 700%, 800%, 900%, 1000%, 1100%, 1200%, 1300%, 1400%, 1500%, 1600%, 1700%, 1800%, 1900%, 2000%, 3000%, 4000%, 5000%, 6000%, 7000%, 8000%, 9000%, 10000% or more compared to the half-life of an unmodified polypeptide. Assays to assess half-life are known and standard in the art.

As used herein, "thermal stability" refers to the measure of the resistance to denaturation of a protein that occurs upon exposure to high or elevated temperatures, and hence is the ability of a protein to function at a particular temperature. A polypeptide is thermally stable at a temperature if it retains at least 50%, 55%, 60%, 65%, 70%, 75%, 80%, 85%, 90%, 95% or more of an activity or a property of the polypeptide at the temperature. Thermal stability can be measured either by known procedures or by the methods described herein. In certain embodiments, thermal stability is evaluated by measuring the melting temperature (Tm) of a protein or by a thermal challenge assay (Tc).

As used herein, "increased thermal stability" refers to a higher degree of resistance to denaturation of a protein. For example, it can mean that a protein is thermally stable at a higher temperature than a reference proteins. It also can mean that a protein exhibits greater retained activity at a particular temperature compared to the activity of a reference protein at the same temperature. In some cases, an increased thermal stability means that a protein has a greater melting temperature Tm compared to a reference protein. For example, the thermal stability is increased if the Tm of a protein is at least 0.1° C., 0.2° C., 0.3° C., 0.4° C., 0.5° C., 0.6° C., 0.7° C., 0.8° C., 0.9° C., 1.0° C., 1.5° C., 2.0° C. 2.5° C. 3.0° C., 4.0° C., 5.0° C. or more greater than a reference or unmodified protein.

As used herein, the melting temperature (Tm; also called transition temperature) is the temperature at the midpoint of a thermal transition curve where 50% of molecules of a composition are in a folded state. Hence, it is the temperature at which 50% of a macromolecule becomes denatured, and is a standard parameter for describing the thermal stability of a protein. Methods to determine Tm are well-known to a skilled artisan and include, for example, analytical spectroscopy methods such as, but are not limited to, differential scanning calorimetry (DSC), circular dichroism (CD) spectroscopy), fluorescence emission spectroscopy or nuclear magnetic resonance (NMR) spectroscopy.

As used herein, "pH optima" or "pH optimum" refers to the pH at which any enzymatic reaction, such as adenosine deaminase activity, is most effective under a given set of conditions. With respect to its adenosine deaminase activity, ADA2 exhibits a pH optima that is or is about 6.5.

As used herein, "altered pH optima" or "altered pH optimum" refers to a change (increased or decreased) in the pH that is the optimal pH for adenosine deaminase activity. An increased pH optimum occurs if the pH optimum is greater than 0.1, 0.2, 0.3, 0.4, 0.5, 0.6, 0.7, 0.8, 0.9, 1.0, 1.1, 1.2, 1.3, 1.4, 1.5, 1.0, 2.5 or more compared to the pH optimum of a reference or unmodified protein. A decreased pH optimum occurs if the pH optimum is lower than or less than 0.1, 0.2, 0.3, 0.4, 0.5, 0.6, 0.7, 0.8, 0.9, 1.0, 1.1, 1.2, 1.3, 1.4, 1.5, 1.0, 2.5 or more less to the pH optimum of a reference or unmodified protein.

As used herein, "bind," "bound" or grammatical variations thereof refers to the participation of a molecule in any attractive interaction with another molecule, resulting in a stable association in which the two molecules are in close proximity to one another. Binding includes, but is not limited to, non-covalent bonds, covalent bonds (such as reversible and irreversible covalent bonds), and includes interactions between molecules such as, but not limited to, proteins, nucleic acids, carbohydrates, lipids, and small molecules, such as chemical compounds including drugs. Typically, bind involves the association of two or more molecules by one or more noncovalent bonds. Binding can be assessed by standard methods known in the art, including but not limited to, equilibrium dialysis, radioimmunoassay radiolabeled target antigen, immunoassays (e.g. enzyme linked immunosorbant assay (ELISA)), surface plasmon resonance (SPR), isothermal titration calorimetry (ITC) and other methods well known to a skilled artisan.

As used herein, binding activity refer to characteristics of a molecule, e.g. a polypeptide, relating to whether or not, and how, it binds one or more binding partners. Binding activities include the ability to bind the binding partner(s), the affinity with which it binds to the binding partner (e.g. high affinity), the avidity with which it binds to the binding partner, the strength of the bond with the binding partner and/or specificity for binding with the binding partner.

As used herein, "heparin binding" refers to the ability of ADA2 to bind heparin, which is a highly sulfated glycosaminoglycan made up of variably sulfated repeating disaccharide units. Commonly, a heparin disaccharide unit is made up of a 2-O-sulfated iduronic acid and 6-O-sulfated, N-sulfated glucosamine, IdoA(2S)-GlcNS(6S).

As used herein, "reduced heparin binding" or "attenuated heparin binding" refers to a lessening or reduced binding activity for heparin. For example, it can mean that the level or degree of binding of an ADA2 protein, such as a variant ADA2, is less than a reference protein. For example, the heparin binding is reduced if the level or degree of binding of an ADA2 protein to heparin is no more than 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, or 95% of the binding of a reference or unmodified ADA2 protein to heparin. In some cases, heparin binding is reduced at least or at least about 0.5-fold, 1-fold, 1.5-fold, 2-fold, 3-fold, 4-fold, 5-fold, 6-fold, 7-fold, 8-fold, 9-fold, 10-fold or more compared to the heparin binding of a reference or unmodified ADA2 protein.

As used herein, "adenosine receptor" or ADR refers to a class of G-protein coupled receptors that bind adenosine. Adenosine receptors also can bind to ADA2. There are four types of adenosine receptors. For example, in humans, the ADRs are designated $A_1$ (SEQ ID NO:533), $A_{2A}$(SEQ ID NO:534), $A_{2B}$ (SEQ ID NO:535) and $A_3$ (SEQ ID NOS:536-538).

As used herein, "receptor binding" refers to the ability of ADA2 to bind an adenosine receptor.

As used herein, "reduced receptor binding" refers to a lessening or reduced binding activity for an adenosine receptor. For example, it can mean that the level or degree of binding of an ADA2 protein, such as a variant ADA2, is less than the binding of a reference protein for the same adenosine receptor. For example, receptor binding is reduced if the level or degree of an ADA2 protein for an adenosine receptor is no more than 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, or 95% of the binding of a reference or unmodified ADA2 protein for the same adenosine receptor. In some cases, receptor binding is reduced at least or at least about 0.5-fold, 1-fold, 1.5-fold, 2-fold, 3-fold, 4-fold, 5-fold, 6-fold, 7-fold, 8-fold, 9-fold, 10-fold or more compared to the receptor binding of a reference or unmodified ADA2 protein for the same adenosine receptor.

As used herein, recitation that proteins are "compared under the same conditions" means that different proteins are treated identically or substantially identically such that any one or more conditions that can influence the activity or properties of a protein or agent are not varied or not substantially varied between the test agents. For example, when the adenosine deaminase activity of an ADA2 is compared to an unmodified ADA2 protein any one or more conditions such as the amount or concentration of the protein; presence, including amount, of excipients, carriers or other components in a formulation other than the active agent; temperature; pH and/or other conditions are identical or substantially identical between and among the compared polypeptides.

As used herein, "immune checkpoints" refer to inhibitory pathways of the immune system that are responsible for maintaining self-tolerance and modulating the duration and amplitude of physiological immune responses in peripheral tissues in order to minimize collateral tissue damage. Immune checkpoints are regulated by immune checkpoint proteins.

An "immune checkpoint protein" is a protein, typically a receptor (e.g., CTLA4 or PD-1) or a ligand (e.g., PD-L1) that regulates or modulates the extent of an immune response. The immune checkpoint proteins can be inhibitory or stimulatory. In particular, the immune checkpoint proteins are inhibitory to the activation of the immune response. Thus, inhibition of an inhibitory immune checkpoint protein acts to stimulate or activate an immune response, such as T cell activation and proliferation.

As used herein, an "immune checkpoint inhibitor" or "immune checkpoint inhibiting agent," or "immune checkpoint blocking agent" refers to an agent that binds an inhibitory immune checkpoint protein and blocks its activity. The inhibition can be competitive or non-competitive inhibition that can be steric or allosteric. In cases where an immune checkpoint protein is an immune stimulating protein, an immune checkpoint inhibitor acts to promote the activity of the immune stimulating protein, such as by binding and activating the stimulatory immune checkpoint protein or by inhibiting by interfering with, such as by binding or deactivating, inhibitors of the stimulatory immune checkpoint protein. An example of an immune checkpoint inhibitor is an anti-immune checkpoint protein antibody.

A "target" of an immune checkpoint inhibitor is the immune checkpoint protein to which the immune checkpoint inhibitor or immune checkpoint inhibiting agent binds to block activity. Typically, the immune checkpoint inhibitor specifically binds to the target. For example, the target of the exemplary anti-CTLA4 antibody designated ipilimumab is CTLA4.

As used herein, an anti-immune checkpoint protein antibody, refers to any antibody that specifically binds to an immune checkpoint protein or a soluble fragment thereof and blocks. An anti-immune checkpoint protein antibody typically binds an immune checkpoint ligand protein or an immune checkpoint receptor protein and blocks the binding of a receptor to the target immune checkpoint ligand protein or a ligand to the target immune checkpoint receptor protein, thereby preventing the inhibitory signal transduction that suppresses an immune response. Hence, anti-immune checkpoint protein antibodies are immune checkpoint inhibitors. Reference to anti-immune checkpoint protein antibodies herein include full-length antibodies and antigen-binding fragments thereof that specifically bind to an immune checkpoint ligand or receptor protein. Exemplary anti-immune checkpoint protein antibodies include, but are not limited to, anti-cytotoxic T-lymphocyte-associated protein 4 (CTLA4) antibodies and anti-programmed cell death protein 1 (PD-1) antibodies.

As used herein, an antigen-binding fragment of an anti-immune checkpoint protein antibody refers to an antibody derived from an anti-immune checkpoint protein antibody but that is less than the full length sequence of the anti-immune checkpoint protein antibody but contains at least a portion of the variable regions (heavy and light) of the antibody sufficient to form an antigen binding site (e.g., one or more CDRs, and generally all CDRs) and thus retains the binding specificity and/or activity of the anti-immune checkpoint protein antibody.

As used herein, anti-CTLA4 antibody refers to any antibody that specifically binds to cytotoxic T-lymphocyte-associated protein 4 (CTLA4) or a soluble fragment thereof and blocks the binding of ligands to CTLA4, thereby resulting in competitive inhibition of CTLA4 and inhibition of CTLA4-mediated inhibition of T cell activation. Hence, anti-CTLA4 antibodies are CTLA4 inhibitors. Reference to anti-CTLA4 antibodies herein include a full-length antibody and derivatives thereof, such as antigen-binding fragments thereof that specifically bind to CTLA4. Exemplary anti-CTLA4 antibodies include, but are not limited to, Ipilimumab or Tremelimumab, or a derivative or antigen-binding fragment thereof.

As used herein, anti-PD-1 antibody refers to any antibody that specifically binds to programmed cell death protein 1 (PD-1) or a soluble fragment thereof and blocks the binding of ligands to PD-1, thereby resulting in competitive inhibition of PD-1 and inhibition of PD-1-mediated inhibition of T cell activation. Hence, anti-PD-1 antibodies are PD-1 inhibitors. Reference to anti-PD-1 antibodies herein include a full-length antibody and derivatives thereof, such as antigen-binding fragments thereof that specifically bind to PD-1. Exemplary anti-PD-1 antibodies include, but are not limited to, Nivolumab, MK-3475, Pidilizumab, or a derivative or antigen-binding fragment thereof.

As used herein, anti-PD-L1 antibody refers to an antibody that specifically binds to programmed death-ligand 1 (PD-L1) or a soluble fragment thereof and blocking the binding of the ligand to PD-1, thereby resulting in competitive inhibition of PD-1 and inhibition of PD-1-mediated inhibition of T cell activity. Hence, anti-PD-L1 antibodies are PD-1 inhibitors. Reference to anti-PD-L1 antibodies herein include a full-length antibody and derivatives thereof, such as antigen-binding fragments thereof that specifically bind to PD-L1. Exemplary anti-PD-L1 antibodies include, but are not limited to, BMS-936559, MPDL3280A, MEDI4736 or a derivative or antigen-binding fragment thereof.

As used herein, "antibody" refers to immunoglobulins and immunoglobulin fragments, whether natural or partially or wholly synthetically, such as recombinantly, produced, including any fragment thereof containing at least a portion of the variable heavy chain and light region of the immunoglobulin molecule that is sufficient to form an antigen binding site and, when assembled, to specifically bind antigen. Hence, an antibody includes any protein having a binding domain that is homologous or substantially homologous to an immunoglobulin antigen-binding domain (antibody combining site). For example, an antibody refers to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g., heavy chains include, but are not limited to, VH chains, VH-CH1 chains and VH-CH1-CH2-CH3 chains), and each light chain can be a full-length light chain or a portion thereof sufficient to form an antigen binding site (e.g., light chains include, but are not limited to, VL chains and VL-CL chains). Each heavy chain (H and H') pairs with one light chain (L and L', respectively). Typically, antibodies minimally include all or at least a portion of the variable heavy (VH) chain and/or the variable light (VL) chain. The antibody also can include all or a portion of the constant region.

For purposes herein, the term antibody includes full-length antibodies and portions thereof including antibody fragments. Antibody fragments, include, but are not limited to, Fab fragments, Fab' fragments, F(ab')$_2$ fragments, Fv fragments, disulfide-linked Fvs (dsFv), Fd fragments, Fd' fragments, single-chain Fvs (scFv), single-chain Fabs (scFab), diabodies, anti-idiotypic (anti-Id) antibodies, or antigen-binding fragments of any of the above. Antibody also includes synthetic antibodies, recombinantly produced antibodies, multispecific antibodies (e.g., bispecific antibodies), human antibodies, non-human antibodies, humanized antibodies, chimeric antibodies, and intrabodies. Antibodies provided herein include members of any immunoglobulin type (e.g., IgG IgM, IgD, IgE, IgA and IgY), any class (e.g., IgG1, IgG2, IgG3, IgG4, IgA1 and IgA2) or subclass (e.g., IgG2a and IgG2b).

As used herein, the phrase "derived from" or "derivative" when referring to antibody fragments derived from another antibody, such as a monoclonal antibody, refers to the engineering of antibody fragments (e.g., Fab, F(ab'), F(ab')$_2$, single-chain Fv (scFv), Fv, dsFv, diabody, Fd and Fd' fragments) that retain the binding specificity of the original or parent antibody. Such fragments can be derived by a variety of methods known in the art, including, but not limited to, enzymatic cleavage, chemical crosslinking, recombinant means or combinations thereof. Generally, the derived antibody fragment shares the identical or substantially identical heavy chain variable region ($V_H$) and light chain variable region ($V_L$) of the parent antibody, such that the antibody fragment and the parent antibody bind the same epitope.

As used herein, an anti-hyaluronan agent refers to any agent that modulates hyaluronan (HA) synthesis or degradation, thereby altering hyaluronan levels in a tissue or cell. For purposes herein, anti-hyaluronan agents reduce hyaluronan levels in a tissue or cell compared to the absence of the agent. Such agents include compounds that modulate the expression of genetic material encoding HA synthase (HAS) and other enzymes or receptors involved in hyaluronan metabolism, or that modulate the proteins that synthesize or degrade hyaluronan including HAS function or activity. The agents include small-molecules, nucleic acids, peptides, proteins or other compounds. For example, anti-hyaluronan agents include, but are not limited to, antisense or sense molecules, antibodies, enzymes, small molecule inhibitors and HAS substrate analogs.

As used herein, a hyaluronan degrading enzyme refers to an enzyme that catalyzes the cleavage of a hyaluronan polymer (also referred to as hyaluronic acid or HA) into smaller molecular weight fragments. Exemplary hyaluronan degrading enzymes are hyaluronidases, and particular chondroitinases and lyases that have the ability to depolymerize hyaluronan Exemplary chondroitinases that are hyaluronan degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase.

As used herein, hyaluronidase refers to a class of hyaluronan degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. For example, hyaluronidases include those of human origin. Exemplary human hyaluronidases include HYAL1, HYAL2, HYAL3, HYAL4, and PH20 (SEQ ID NO:480 and 551). Also included amongst hyaluronidases are soluble hyaluronidases, including, ovine and bovine PH20, soluble human PH20 and soluble rHuPH20. Examples of commercially available bovine or ovine soluble hyaluronidases include Vitrase® (ovine hyaluronidase), Amphadase® (bovine hyaluronidase) and Hydase™ (bovine hyaluronidase).

Reference to hyaluronan degrading enzymes or hyaluronidase includes precursor hyaluronan degrading enzyme polypeptides and mature hyaluronan degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides, or the mature forms thereof. Hyaluronan degrading enzymes and hyaluronidase also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, "bovine PH20" refers to a bovine hyaluronidase purified from bovine testicular extracts (see U.S. Pat. Nos. 2,488,564, 2,488,565, 2,806,815, 2,808,362, 2,676,139, 2,795,529, 5,747,027 and 5,827,721). Examples of commercially available purified bovine testicular hyaluronidases include Amphadase® and Hydase™, and bovine hyaluronidases, including, but not limited to, those available from Sigma Aldrich, Abnova, EMD Chemicals, GenWay Biotech, Inc., Raybiotech, Inc., and Calzyme. Also included are recombinantly produced bovine hyaluronidases.

As used herein, "ovine PH20" refers to an ovine hyaluronidase purified from ovine testicular extracts (see U.S. Pat. Nos. 2,488,564, 2,488,565 and 2,806,815 and International PCT Publication No. WO2005/118799). Examples of commercially available purified ovine testicular extract include Vitrase®, and ovine hyaluronidases, including, but not limited to, those available from Sigma Aldrich, Cell Sciences, EMD Chemicals, GenWay Biotech, Inc., Mybiosource.com and Raybiotech, Inc. Also included are recombinantly produced ovine hyaluronidases.

As used herein, "PH20" refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (precursor set forth in SEQ ID NO:551 and mature set forth in SEQ ID NO:480).

As used herein, a "soluble PH20" refers to any form of PH20 that is soluble under physiologic conditions. A soluble PH20 can be identified, for example, by its partitioning into the aqueous phase of a Triton® X-114 solution at 37° C. (Bordier et al., (1981) *J. Biol. Chem.,* 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also includes recombinant soluble PH20 and those contained in or purified from natural sources, such as, for example, testes extracts from sheep or cows. An example of such soluble PH20 is soluble human PH20. Exemplary soluble human PH20 polypeptides are set forth in any of SEQ ID NOS:481-488, 493-514, or 526-532, or has a sequence of amino acids that is at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS:481-488, 493-514, or 526-532 and is soluble and retains hyaluronidase activity.

As used herein, "soluble recombinant human PH20 (rHuPH20)" refers to a composition containing soluble form of human PH20 as recombinantly expressed and secreted in Chinese Hamster Ovary (CHO) cells. Soluble rHuPH20 is encoded by nucleic acid molecule that includes the signal sequence and encodes the polypeptide set forth in SEQ ID NO:481. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NO:481-486 in various abundance.

As used herein, "hyaluronidase activity" refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc., Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay that measures cleavage of hyaluronic acid by hyaluronidase indirectly by detecting the insoluble precipitate formed when the uncleaved hyaluronic acid binds with serum albumin and the biotinylated-hyaluronic acid assay that measures the cleavage of hyaluronic acid indirectly by detecting the remaining biotinylated-hyaluronic acid non-covalently bound to microtiter plate wells with a streptavidin-horseradish peroxidase conjugate and a chromogenic substrate. Reference Standards can be used, for example, to generate a standard curve to determine the activity in Units of the hyaluronidase being tested.

As used herein, "neutral active" refers to the ability of a PH20 polypeptide to enzymatically catalyze the cleavage of hyaluronic acid at neutral pH (e.g., at or about pH 7.0).

As used herein, an anti-cancer agent or chemotherapeutic agent refers to an agent that is capable of killing cells that divide rapidly, such as cancer cells. One of skill in the art is familiar with anti-cancer agents, including chemotherapeutic agents. Exemplary agents are described herein.

As used herein, "biological activity" refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a ADA2 encompasses adenosine deaminase activity.

As used herein the term "assess", and grammatical variations thereof, is intended to include quantitative and qualitative determination in the sense of obtaining an absolute value for the activity of a polypeptide, and also of obtaining an index, ratio, percentage, visual or other value indicative of the level of the activity. Assessment can be direct or indirect. For example, detection of cleavage of a substrate by a polypeptide can be by direct measurement of the product, or can be indirectly measured by determining the resulting activity of the cleaved substrate.

As used herein, "mature numbering" or "standard numbering" refers to the numbering of residues in order based on a mature ADA2 polypeptide. For purposes herein, mature numbering is based on the numbering of residues of mature ADA2 set forth in SEQ ID NO:5.

As used herein, "Zavialov numbering" refers to the numbering of residues used in Zavialov et al. (2010) J. Biol. Chem. 285:12367-12377 and in PDB accession Nos. 3LGG and 3LGD. Zavialov numbering is based on the numbering of residues of ADA2 as set forth in SEQ ID NO:4. Hence Zavialov numbering can be determined by alignment with SEQ ID NO:4. Table 1 below sets forth the corresponding position numbers between mature numbering and Zavialov numbering. Table 1 provides the sequence of amino acids set forth in SEQ ID NO:4 (reference sequence for Zavialov numbering), its position numbers and the corresponding position numbers for SEQ ID NO:5 (reference sequence for mature numbering as used herein).

TABLE 1

Corresponding Position Numbers for Mature Numbering (SEQ ID NO: 5) and Zavialov Numbering (SEQ ID NO: 4)

| | | | | | | | | | |
|---|---|---|---|---|---|---|---|---|---|
| SEQ ID NO: 5 (mature) | | | | 1 | 2 | 3 | 4 | 5 | 6 | 7 |
| SEQ ID NO: 4 (Zavialov) | 1 | 2 | 3 | 4 | 5 | 6 | 7 | 8 | 9 | 10 |
| Sequence (SEQ ID NO: 4) | G | G | S | I | D | E | T | R | A | H |
| SEQ ID NO: 5 (mature) | 8 | 9 | 10 | 11 | 12 | 13 | 14 | 15 | 16 | 17 |
| SEQ ID NO: 4 (Zavialov) | 11 | 12 | 13 | 14 | 15 | 16 | 17 | 18 | 19 | 20 |
| Sequence (SEQ ID NO: 4) | L | L | L | K | E | K | M | M | R | L |
| SEQ ID NO: 5 (mature) | 18 | 19 | 20 | 21 | 22 | 23 | 24 | 25 | 26 | 27 |
| SEQ ID NO: 4 (Zavialov) | 21 | 22 | 23 | 24 | 25 | 26 | 27 | 28 | 29 | 30 |
| Sequence (SEQ ID NO: 4) | G | G | R | L | V | L | N | T | K | E |
| SEQ ID NO: 5 (mature) | 28 | 29 | 30 | 31 | 32 | 33 | 34 | 35 | 36 | 37 |
| SEQ ID NO: 4 (Zavialov) | 31 | 32 | 33 | 34 | 35 | 36 | 37 | 38 | 39 | 40 |
| Sequence (SEQ ID NO: 4) | E | L | A | N | E | R | L | M | T | L |
| SEQ ID NO: 5 (mature) | 38 | 39 | 40 | 41 | 42 | 43 | 44 | 45 | 46 | 47 |
| SEQ ID NO: 4 (Zavialov) | 41 | 42 | 43 | 44 | 45 | 46 | 47 | 48 | 49 | 50 |
| Sequence (SEQ ID NO: 4) | K | I | A | E | M | K | E | A | M | R |
| SEQ ID NO: 5 (mature) | 48 | 49 | 50 | 51 | 52 | 53 | 54 | 55 | 56 | 57 |
| SEQ ID NO: 4 (Zavialov) | 51 | 52 | 53 | 54 | 55 | 56 | 57 | 58 | 59 | 60 |
| Sequence (SEQ ID NO: 4) | T | L | I | F | P | P | S | M | H | F |
| SEQ ID NO: 5 (mature) | 58 | 59 | 60 | 61 | 62 | 63 | 64 | 65 | 66 | 67 |
| SEQ ID NO: 4 (Zavialov) | 61 | 62 | 63 | 64 | 65 | 66 | 67 | 68 | 69 | 70 |
| Sequence (SEQ ID NO: 4) | F | Q | A | K | H | L | I | E | R | S |
| SEQ ID NO: 5 (mature) | 68 | 69 | 70 | 71 | 72 | 73 | 74 | 75 | 76 | 77 |
| SEQ ID NO: 4 (Zavialov) | 71 | 72 | 73 | 74 | 75 | 76 | 77 | 78 | 79 | 80 |
| Sequence (SEQ ID NO: 4) | Q | V | F | N | I | L | R | M | M | P |
| SEQ ID NO: 5 (mature) | 78 | 79 | 80 | 81 | 82 | 83 | 84 | 85 | 86 | 87 |
| SEQ ID NO: 4 (Zavialov) | 81 | 82 | 83 | 84 | 85 | 86 | 87 | 88 | 89 | 90 |
| Sequence (SEQ ID NO: 4) | K | G | A | A | L | H | L | H | D | I |
| SEQ ID NO: 5 (mature) | 88 | 89 | 90 | 91 | 92 | 93 | 94 | 95 | 96 | 97 |
| SEQ ID NO: 4 (Zavialov) | 91 | 92 | 93 | 94 | 95 | 96 | 97 | 98 | 99 | 100 |
| Sequence (SEQ ID NO: 4) | G | I | V | T | M | D | W | L | V | R |
| SEQ ID NO: 5 (mature) | 98 | 99 | 100 | 101 | 102 | 103 | 104 | 105 | 106 | 107 |
| SEQ ID NO: 4 (Zavialov) | 101 | 102 | 103 | 104 | 105 | 106 | 107 | 108 | 109 | 110 |
| Sequence (SEQ ID NO: 4) | N | V | T | Y | R | P | H | C | H | I |
| SEQ ID NO: 5 (mature) | 108 | 109 | 110 | 111 | 112 | 113 | 114 | 115 | 116 | 117 |
| SEQ ID NO: 4 (Zavialov) | 111 | 112 | 113 | 114 | 115 | 116 | 117 | 118 | 119 | 120 |
| Sequence (SEQ ID NO: 4) | C | F | T | P | R | G | I | M | Q | F |
| SEQ ID NO: 5 (mature) | 118 | 119 | 120 | 121 | 122 | 123 | 124 | 125 | 126 | 127 |
| SEQ ID NO: 4 (Zavialov) | 121 | 122 | 123 | 124 | 125 | 126 | 127 | 128 | 129 | 130 |
| Sequence (SEQ ID NO: 4) | R | F | A | H | P | T | P | R | P | S |

TABLE 1-continued

Corresponding Position Numbers for Mature Numbering
(SEQ ID NO: 5) and Zavialov Numbering (SEQ ID NO: 4)

| | | | | | | | | | |
|---|---|---|---|---|---|---|---|---|---|
| SEQ ID NO: 5 (mature) | 128 | 129 | 130 | 131 | 132 | 133 | 134 | 135 | 136 | 137 |
| SEQ ID NO: 4 (Zavialov) | 131 | 132 | 133 | 134 | 135 | 136 | 137 | 138 | 139 | 140 |
| Sequence (SEQ ID NO: 4) | E | K | C | S | K | W | I | L | L | E |
| SEQ ID NO: 5 (mature) | 138 | 139 | 140 | 141 | 142 | 143 | 144 | 145 | 146 | 147 |
| SEQ ID NO: 4 (Zavialov) | 141 | 142 | 143 | 144 | 145 | 146 | 147 | 148 | 149 | 150 |
| Sequence (SEQ ID NO: 4) | D | Y | R | K | R | V | Q | N | V | T |
| SEQ ID NO: 5 (mature) | 148 | 149 | 150 | 151 | 152 | 153 | 154 | 155 | 156 | 157 |
| SEQ ID NO: 4 (Zavialov) | 151 | 152 | 153 | 154 | 155 | 156 | 157 | 158 | 159 | 160 |
| Sequence (SEQ ID NO: 4) | E | F | D | D | S | L | L | R | N | F |
| SEQ ID NO: 5 (mature) | 158 | 159 | 160 | 161 | 162 | 163 | 164 | 165 | 166 | 167 |
| SEQ ID NO: 4 (Zavialov) | 161 | 162 | 163 | 164 | 165 | 166 | 167 | 168 | 169 | 170 |
| Sequence (SEQ ID NO: 4) | T | L | V | T | Q | H | P | E | V | I |
| SEQ ID NO: 5 (mature) | 168 | 169 | 170 | 171 | 172 | 173 | 174 | 175 | 176 | 177 |
| SEQ ID NO: 4 (Zavialov) | 171 | 172 | 173 | 174 | 175 | 176 | 177 | 178 | 179 | 180 |
| Sequence (SEQ ID NO: 4) | Y | T | N | Q | N | V | V | W | S | K |
| SEQ ID NO: 5 (mature) | 178 | 179 | 180 | 181 | 182 | 183 | 184 | 185 | 186 | 187 |
| SEQ ID NO: 4 (Zavialov) | 181 | 182 | 183 | 184 | 185 | 186 | 187 | 188 | 189 | 190 |
| Sequence (SEQ ID NO: 4) | F | E | T | I | F | F | T | I | S | G |
| SEQ ID NO: 5 (mature) | 188 | 189 | 190 | 191 | 192 | 193 | 194 | 195 | 196 | 197 |
| SEQ ID NO: 4 (Zavialov) | 191 | 192 | 193 | 194 | 195 | 196 | 197 | 198 | 199 | 200 |
| Sequence (SEQ ID NO: 4) | L | I | H | Y | A | P | V | F | R | D |
| SEQ ID NO: 5 (mature) | 198 | 199 | 200 | 201 | 202 | 203 | 204 | 205 | 206 | 207 |
| SEQ ID NO: 4 (Zavialov) | 201 | 202 | 203 | 204 | 205 | 206 | 207 | 208 | 209 | 210 |
| Sequence (SEQ ID NO: 4) | Y | V | F | R | S | M | Q | E | F | Y |
| SEQ ID NO: 5 (mature) | 208 | 209 | 210 | 211 | 212 | 213 | 214 | 215 | 216 | 217 |
| SEQ ID NO: 4 (Zavialov) | 211 | 212 | 213 | 214 | 215 | 216 | 217 | 218 | 219 | 220 |
| Sequence (SEQ ID NO: 4) | E | D | N | V | L | Y | M | E | I | R |
| SEQ ID NO: 5 (mature) | 218 | 219 | 220 | 221 | 222 | 223 | 224 | 225 | 226 | 227 |
| SEQ ID NO: 4 (Zavialov) | 221 | 222 | 223 | 224 | 225 | 226 | 227 | 228 | 229 | 230 |
| Sequence (SEQ ID NO: 4) | A | R | L | L | P | V | Y | E | L | S |
| SEQ ID NO: 5 (mature) | 228 | 229 | 230 | 231 | 232 | 233 | 234 | 235 | 236 | 237 |
| SEQ ID NO: 4 (Zavialov) | 231 | 232 | 233 | 234 | 235 | 236 | 237 | 238 | 239 | 240 |
| Sequence (SEQ ID NO: 4) | G | E | H | H | D | E | E | W | S | V |
| SEQ ID NO: 5 (mature) | 238 | 239 | 240 | 241 | 242 | 243 | 244 | 245 | 246 | 247 |
| SEQ ID NO: 4 (Zavialov) | 241 | 242 | 243 | 244 | 245 | 246 | 247 | 248 | 249 | 250 |
| Sequence (SEQ ID NO: 4) | K | T | Y | Q | E | V | A | Q | K | F |
| SEQ ID NO: 5 (mature) | 248 | 249 | 250 | 251 | 252 | 253 | 254 | 255 | 256 | 257 |
| SEQ ID NO: 4 (Zavialov) | 251 | 252 | 253 | 254 | 255 | 256 | 257 | 258 | 259 | 260 |
| Sequence (SEQ ID NO: 4) | V | E | T | H | P | E | F | I | G | I |
| SEQ ID NO: 5 (mature) | 258 | 259 | 260 | 261 | 262 | 263 | 264 | 265 | 266 | 267 |
| SEQ ID NO: 4 (Zavialov) | 261 | 262 | 263 | 264 | 265 | 266 | 267 | 268 | 269 | 270 |
| Sequence (SEQ ID NO: 4) | K | I | I | Y | S | D | H | R | S | K |
| SEQ ID NO: 5 (mature) | 268 | 269 | 270 | 271 | 272 | 273 | 274 | 275 | 276 | 277 |
| SEQ ID NO: 4 (Zavialov) | 271 | 272 | 273 | 274 | 275 | 276 | 277 | 278 | 279 | 280 |
| Sequence (SEQ ID NO: 4) | D | V | A | V | I | A | E | S | I | R |
| SEQ ID NO: 5 (mature) | 278 | 279 | 280 | 281 | 282 | 283 | 284 | 285 | 286 | 287 |
| SEQ ID NO: 4 (Zavialov) | 281 | 282 | 283 | 284 | 285 | 286 | 287 | 288 | 289 | 290 |
| Sequence (SEQ ID NO: 4) | M | A | M | G | L | R | I | K | F | P |
| SEQ ID NO: 5 (mature) | 288 | 289 | 290 | 291 | 292 | 293 | 294 | 295 | 296 | 297 |
| SEQ ID NO: 4 (Zavialov) | 291 | 292 | 293 | 294 | 295 | 296 | 297 | 298 | 299 | 300 |
| Sequence (SEQ ID NO: 4) | T | V | V | A | G | F | D | L | V | G |
| SEQ ID NO: 5 (mature) | 298 | 299 | 300 | 301 | 302 | 303 | 304 | 305 | 306 | 307 |
| SEQ ID NO: 4 (Zavialov) | 301 | 302 | 303 | 304 | 305 | 306 | 307 | 308 | 309 | 310 |
| Sequence (SEQ ID NO: 4) | H | E | D | T | G | H | S | L | H | D |
| SEQ ID NO: 5 (mature) | 308 | 309 | 310 | 311 | 312 | 313 | 314 | 315 | 316 | 317 |
| SEQ ID NO: 4 (Zavialov) | 311 | 312 | 313 | 314 | 315 | 316 | 317 | 318 | 319 | 320 |
| Sequence (SEQ ID NO: 4) | Y | K | E | A | L | M | I | P | A | K |
| SEQ ID NO: 5 (mature) | 318 | 319 | 320 | 321 | 322 | 323 | 324 | 325 | 326 | 327 |
| SEQ ID NO: 4 (Zavialov) | 321 | 322 | 323 | 324 | 325 | 326 | 327 | 328 | 329 | 330 |
| Sequence (SEQ ID NO: 4) | D | G | V | K | L | P | Y | F | F | H |
| SEQ ID NO: 5 (mature) | 328 | 329 | 330 | 331 | 332 | 333 | 334 | 335 | 336 | 337 |
| SEQ ID NO: 4 (Zavialov) | 331 | 332 | 333 | 334 | 335 | 336 | 337 | 338 | 339 | 340 |
| Sequence (SEQ ID NO: 4) | A | G | E | T | D | W | Q | G | T | S |
| SEQ ID NO: 5 (mature) | 338 | 339 | 340 | 341 | 342 | 343 | 344 | 345 | 346 | 347 |
| SEQ ID NO: 4 (Zavialov) | 341 | 342 | 343 | 344 | 345 | 346 | 347 | 348 | 349 | 350 |
| Sequence (SEQ ID NO: 4) | I | D | R | N | I | L | D | A | L | M |
| SEQ ID NO: 5 (mature) | 348 | 349 | 350 | 351 | 352 | 353 | 354 | 355 | 356 | 357 |
| SEQ ID NO: 4 (Zavialov) | 351 | 352 | 353 | 354 | 355 | 356 | 357 | 358 | 359 | 360 |
| Sequence (SEQ ID NO: 4) | L | N | T | T | R | I | G | H | G | F |
| SEQ ID NO: 5 (mature) | 358 | 359 | 360 | 361 | 362 | 363 | 364 | 365 | 366 | 367 |
| SEQ ID NO: 4 (Zavialov) | 361 | 362 | 363 | 364 | 365 | 366 | 367 | 368 | 369 | 370 |
| Sequence (SEQ ID NO: 4) | A | L | S | K | H | P | A | V | R | T |
| SEQ ID NO: 5 (mature) | 368 | 369 | 370 | 371 | 372 | 373 | 374 | 375 | 376 | 377 |
| SEQ ID NO: 4 (Zavialov) | 371 | 372 | 373 | 374 | 375 | 376 | 377 | 378 | 379 | 380 |
| Sequence (SEQ ID NO: 4) | Y | S | W | K | K | D | I | P | I | E |
| SEQ ID NO: 5 (mature) | 378 | 379 | 380 | 381 | 382 | 383 | 384 | 385 | 386 | 387 |
| SEQ ID NO: 4 (Zavialov) | 381 | 382 | 383 | 384 | 385 | 386 | 387 | 388 | 389 | 390 |

TABLE 1-continued

Corresponding Position Numbers for Mature Numbering
(SEQ ID NO: 5) and Zavialov Numbering (SEQ ID NO: 4)

| Sequence (SEQ ID NO: 4) | V | C | P | I | S | N | Q | V | L | K |
|---|---|---|---|---|---|---|---|---|---|---|
| SEQ ID NO: 5 (mature) | 388 | 389 | 390 | 391 | 392 | 393 | 394 | 395 | 396 | 397 |
| SEQ ID NO: 4 (Zavialov) | 391 | 392 | 393 | 394 | 395 | 396 | 397 | 398 | 399 | 400 |
| Sequence (SEQ ID NO: 4) | L | V | S | D | L | R | N | H | P | V |
| SEQ ID NO: 5 (mature) | 398 | 399 | 400 | 401 | 402 | 403 | 404 | 405 | 406 | 407 |
| SEQ ID NO: 4 (Zavialov) | 401 | 402 | 403 | 404 | 405 | 406 | 407 | 408 | 409 | 410 |
| Sequence (SEQ ID NO: 4) | A | T | L | M | A | T | G | H | P | M |
| SEQ ID NO: 5 (mature) | 408 | 409 | 410 | 411 | 412 | 413 | 414 | 415 | 416 | 417 |
| SEQ ID NO: 4 (Zavialov) | 411 | 412 | 413 | 414 | 415 | 416 | 417 | 418 | 419 | 420 |
| Sequence (SEQ ID NO: 4) | V | I | S | S | D | D | P | A | M | F |
| SEQ ID NO: 5 (mature) | 418 | 419 | 420 | 421 | 422 | 423 | 424 | 425 | 426 | 427 |
| SEQ ID NO: 4 (Zavialov) | 421 | 422 | 423 | 424 | 425 | 426 | 427 | 428 | 429 | 430 |
| Sequence (SEQ ID NO: 4) | G | A | K | G | L | S | Y | D | F | Y |
| SEQ ID NO: 5 (mature) | 428 | 429 | 430 | 431 | 432 | 433 | 434 | 435 | 436 | 437 |
| SEQ ID NO: 4 (Zavialov) | 431 | 432 | 433 | 434 | 435 | 436 | 437 | 438 | 439 | 440 |
| Sequence (SEQ ID NO: 4) | E | V | F | M | G | I | G | G | M | K |
| SEQ ID NO: 5 (mature) | 438 | 439 | 440 | 441 | 442 | 443 | 444 | 445 | 446 | 447 |
| SEQ ID NO: 4 (Zavialov) | 441 | 442 | 443 | 444 | 445 | 446 | 447 | 448 | 449 | 450 |
| Sequence (SEQ ID NO: 4) | A | D | L | R | T | L | K | Q | L | A |
| SEQ ID NO: 5 (mature) | 448 | 449 | 450 | 451 | 452 | 453 | 454 | 455 | 456 | 457 |
| SEQ ID NO: 4 (Zavialov) | 451 | 452 | 453 | 454 | 455 | 456 | 457 | 458 | 459 | 460 |
| Sequence (SEQ ID NO: 4) | M | N | S | I | K | Y | S | T | L | L |
| SEQ ID NO: 5 (mature) | 458 | 459 | 460 | 461 | 462 | 463 | 464 | 465 | 466 | 467 |
| SEQ ID NO: 4 (Zavialov) | 461 | 462 | 463 | 464 | 465 | 466 | 467 | 468 | 469 | 470 |
| Sequence (SEQ ID NO: 4) | E | S | E | K | N | T | F | M | E | I |
| SEQ ID NO: 5 (mature) | 468 | 469 | 470 | 471 | 472 | 473 | 474 | 475 | 476 | 477 |
| SEQ ID NO: 4 (Zavialov) | 471 | 472 | 473 | 474 | 475 | 476 | 477 | 478 | 479 | 480 |
| Sequence (SEQ ID NO: 4) | W | K | K | R | W | D | K | F | I | A |
| SEQ ID NO: 5 (mature) | 478 | 479 | 480 | 481 | 482 | | | | | |
| SEQ ID NO: 4 (Zavialov) | 481 | 482 | 483 | 484 | 485 | | | | | |
| Sequence (SEQ ID NO: 4) | D | V | A | T | K | | | | | |

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to an ADA2 protein linked directly or indirectly to one or more other polypeptides or chemical moieties, whereby at least one ADA2 polypeptide subunit is linked, directly or indirectly to another polypeptide or chemical moiety so long as the conjugate retains adenosine deaminase activity.

As used herein, "coupled" or "conjugated" means attached via a covalent or noncovalent interaction.

As used herein, a chimeric polypeptide refers to a polypeptide that contains portions from at least two different polypeptides or from two non-contiguous portions of a single polypeptide. Thus, a chimeric polypeptide generally includes a sequence of amino acid residues from all or part of one polypeptide and a sequence of amino acids from all or part of another different polypeptide. The two portions can be linked directly or indirectly and can be linked via peptide bonds, other covalent bonds covalent interactions of sufficient strength to maintain the integrity of a substantial portion of the chimeric polypeptide under equilibrium conditions and physiologic conditions, such as in isotonic pH 7 buffered saline.

As used herein, a fusion protein is a polypeptide engineered to contain sequences of amino acids corresponding to two distinct polypeptides, which are joined together, such as by expressing the fusion protein from a vector containing two nucleic acids, encoding the two polypeptides, in close proximity, e.g., adjacent, to one another along the length of the vector. Accordingly, a fusion protein refers to a chimeric protein containing two, or portions from two, or more proteins or peptides that are linked directly or indirectly via peptide bonds. The two molecules can be adjacent in the construct or separated by a linker, or spacer polypeptide.

As used herein, "linker" or "spacer" peptide refers to short sequences of amino acids that join two polypeptide sequences (or nucleic acid encoding such an amino acid sequence). "Peptide linker" refers to the short sequence of amino acids joining the two polypeptide sequences. Exemplary of polypeptide linkers are linkers joining a peptide transduction domain to an antibody or linkers joining two antibody chains in a synthetic antibody fragment such as an scFv fragment. Linkers are well-known and any known linkers can be used in the provided methods. Exemplary of polypeptide linkers are (Gly-Ser)$_n$ amino acid sequences, with some Glu or Lys residues dispersed throughout to increase solubility. Other exemplary linkers are described herein; any of these and other known linkers can be used with the provided compositions and methods.

As used herein, a multimerization domain refers to a sequence of amino acids that promotes stable interaction of a polypeptide molecule with one or more additional polypeptide molecules, each containing a complementary multimerization domain, which can be the same or a different multimerization domain to form a stable multimer with the first domain. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

As used herein, a "moiety" or "heterologous moiety" refers to a molecule that is capable of associating with another molecule, either directly or indirectly by a covalent or non-covalent interaction. Typically, the molecule is derived from a distinct entity from that of the entity to which it is being associated. In one embodiment, a heterologous moiety can be a polypeptide fused to another polypeptide to produce a fusion polypeptide or protein. In another embodiment, a heterologous moiety can be a non-polypeptide such as a polymer, such as a PEG conjugated to a polypeptide or protein.

As used herein, a "half-life extending moiety" is heterologous moiety that facilitates the increased half-life of the molecule to which it is conjugated.

As used herein, "Fc" or "Fc region" or "Fc domain" refers to a polypeptide containing the constant region of an antibody heavy chain, excluding the first constant region immunoglobulin domain. Thus, Fc refers to the last two constant region immunoglobulin domains of IgA, IgD, and IgE, or the last three constant region immunoglobulin domains of IgE and IgM. Optionally, an Fc domain can include all or part of the flexible hinge N-terminal to these domains. For IgA and IgM, Fc can include the J chain. For an exemplary Fc domain of IgG Fc contains immunoglobulin domains Cγ2 and Cγ3, and optionally, all or part of the hinge between Cγ1 and Cγ2. The boundaries of the Fc region can vary, but typically, include at least part of the hinge region. In addition, Fc also includes any allelic or species variant or any variant or modified form, such as any variant or modified form that alters the binding to an FcR or alters an Fc-mediated effector function.

As used herein, "Fc chimera" refers to a chimeric polypeptide in which one or more polypeptides is linked, directly or indirectly, to an Fc region or a derivative thereof. Typically, an Fc chimera combines the Fc region of an immunoglobulin with another polypeptide. Derivatives of or modified Fc polypeptides are known to those of skill in the art.

As used herein, a "polymer" refers to any high molecular weight natural or synthetic moiety that is conjugated to, i.e. stably linked directly or indirectly via a linker, to a polypeptide. Such polymers, typically increase serum half-life, and include, but are not limited to sialic moieties, PEGylation moieties, dextran, and sugar and other moieties, such as for glycosylation. For example, ADA2 proteins, such as a variant ADA2, can be conjugated to a polymer.

As used herein, "PEGylated" refers to covalent or other stable attachment of polymeric molecules, such as polyethylene glycol (PEGylation moiety PEG) to proteins, including an ADA2, such as a variant ADA2. PEGylation can increase half-life of the ADA2.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleotides long.

As used herein, a peptide refers to a polypeptide that is from 2 to 40 amino acids in length.

As used herein, the amino acids that occur in the various sequences of amino acids provided herein are identified according to their known, three-letter or one-letter abbreviations (Table 2). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

In keeping with standard polypeptide nomenclature described in *J. Biol. Chem.*, 243: 3557-3559 (1968), and adopted in 37 C.F.R. §§ 1.821-1.822, abbreviations for the amino acid residues are shown in Table 2:

TABLE 2

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |
| N | Asn | asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 2) and modified and unusual amino acids, such as those referred to in 37 C.F.R. §§ 1.821-1.822, and incorporated herein by reference. A dash at the beginning or end of an amino acid residue sequence indicates a peptide bond to a further sequence of one or more amino acid residues, to an amino-terminal group such as $NH_2$ or to a carboxyl-terminal group such as COOH.

As used herein, a "hydrophobic amino acid" includes any one of the amino acids determined to be hydrophobic using the Eisenberg hydrophobicity consensus scale. Exemplary are the naturally occurring hydrophobic amino acids, such as isoleucine, phenylalanine, valine, leucine, tryptophan, methionine, alanine, glycine, cysteine and tyrosine (Eisenberg et al., (1982) Faraday Symp. Chem. Soc. 17:109-120). Non-naturally-occurring hydrophobic amino acids also are included.

As used herein, an "acidic amino acid" includes among the naturally-occurring amino acids aspartic acid and glutamic acid residues. Non-naturally-occurring acidic amino acids also are included.

As used herein, a "polar amino acid" refers to an amino acid that is a hydrophile, such that the side chains prefer to reside in an aqueous (i.e. water) environment. Such amino acids generally are located on the surface of a protein. Such amino acids generally are classified if they include those with polar side chains that have a functional group such as an acid, amide, alcohol or amine that contains oxygens or nitrogens that can participate in hydrogen bonding with water. Exemplary of such amino acids are Arg (R), Asn (N), Asp (D), Glu (E), Gln (Q), His (H), Lys (K), Ser (S), Thr (T), and Tyr (Y). Cys (C) and Trp (W), which are also considered to be weakly polar.

As used herein, a polar and neutral amino acid is a polar amino acid that contains a neutral side chain. Exemplary of such amino acid residues for replacement are Asn (N), Gln (Q), Ser (S), Thr (T), Cys (C) or Tyr (Y).

As used herein, "naturally occurring amino acids" refer to the 20 L-amino acids that occur in polypeptides.

As used herein, "non-natural amino acid" refers to an organic compound containing an amino group and a carboxylic acid group that is not one of the naturally-occurring amino acids listed in Table 2. Non-naturally occurring amino acids thus include, for example, amino acids or analogs of amino acids other than the 20 naturally-occurring amino acids and include, but are not limited to, the D-stereoisomer of amino acids. Exemplary non-natural amino acids are known to those of skill in the art and can be included in a modified ADA2 polypeptide.

As used herein, suitable conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in Table 3 as follows:

TABLE 3

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule cannot be paired. Such unpaired ends will, in general, not exceed 20 nucleotides in length.

As used herein, "primary sequence" refers to the sequence of amino acid residues in a polypeptide.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, the terms "homology" and "identity" are used interchangeably, but homology for proteins can include conservative amino acid changes. In general to identify corresponding positions the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G, eds., Humana Press, New Jersey, 1994; *Sequence Analysis in Molecular*

*Biology*, von Heinje, G, Academic Press, 1987; and *Sequence Analysis Primer*, Gribskov, M. and Devereux, J., eds., M Stockton Press, New York, 1991; Carrillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well as identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology varies). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FASTA" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Altschul, S. F., et al., *J. Molec. Biol.* 215:403 (1990); *Guide to Huge Computers*, Martin J. Bishop, ed., Academic Press, San Diego (1994), and Carrillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) that are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, it also is understood that the terms "substantially identical" or "similar" varies with the context as understood by those skilled in the relevant art, but that those of skill can assess such.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to an isolated or purified protein or catalytically active protein thereof means that it is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as proteolytic and biological activities, of the substance. Methods for purification of the proteins to produce substantially pure polypeptides are known to those of skill in the art.

The term substantially free of cellular material includes preparations of proteins in which the protein is separated from cellular components of the cells from which it is isolated or recombinantly-produced. In one embodiment, the term substantially free of cellular material includes preparations of protease proteins having less than about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant methods by using recombinant DNA methods refers to the use of the well-known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as bacterial artificial chromosomes, yeast artificial chromosomes and mammalian artificial chromosomes. Selection and use of such vehicles are well known to those of skill in the art.

As used herein, expression refers to the process by which nucleic acid is transcribed into mRNA and translated into peptides, polypeptides, or proteins. If the nucleic acid is derived from genomic DNA, expression can, if an appropriate eukaryotic host cell or organism is selected, include processing, such as splicing of the mRNA.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a "composition" refers to any mixture of two or more products or compounds. It can be a solution, a suspension, liquid, powder, a paste, aqueous, non-aqueous, or any combination thereof.

As used herein, "a combination" refers to any association between two or among more items or elements, for example, two or more items that can be used together. For example, a combination can include an ADA2 protein and another therapeutic agent. Such combinations can be packaged as kits.

As used herein, a kit is a packaged combination, optionally, including instructions for use of the combination and/or other reactions and components for such use.

As used herein, an "article of manufacture" is a product that is made and sold. As used throughout this application, the term is intended to encompass ADA2 proteins, for example variant ADA2 proteins contained in articles of packaging.

As used herein, direct administration refers to a composition that is administered without dilution.

As used herein, a single dosage formulation refers to a formulation for use only once. Typically, a single dosage formulation is for direct administration.

As used herein, a multiple dosage formulation refers to a formulation for use in repeat administrations.

As used herein, when referencing dosage based on mg/kg of the subject, an average human subject is considered to have a mass of about 70 kg-75 kg, such as 70 kg and a body surface area (BSA) of 1.73 $m^2$.

As used herein, "disease or disorder" refers to a pathological condition in an organism resulting from cause or condition including, but not limited to, infections, acquired conditions, genetic conditions, and characterized by identifiable symptoms. Diseases and disorders of interest herein include any associated with aberrant or high adenosine levels.

As used herein, a tumor, also known as a neoplasm, is an abnormal mass of tissue that results when cells proliferate at an abnormally high rate. Tumors can show partial or total lack of structural organization and functional coordination with normal tissue. Tumors can be benign (not cancerous), or malignant (cancerous). As used herein, a tumor is intended to encompass hematopoietic tumors as well as solid tumors.

Malignant tumors can be broadly classified into three major types. Carcinomas are malignant tumors arising from epithelial structures (e.g. breast, prostate, lung, colon, pancreas). Sarcomas are malignant tumors that originate from connective tissues, or mesenchymal cells, such as muscle, cartilage, fat or bone. Leukemias and lymphomas are malignant tumors affecting hematopoietic structures (structures pertaining to the formation of blood cells) including components of the immune system. Other malignant tumors include, but are not limited to, tumors of the nervous system (e.g. neurofibromatomas), germ cell tumors, and blastic tumors.

As used herein, neoplastic disease refers to any disorder involving cancer, including tumor development, growth, metastasis and progression.

As used herein, cancer is a term for diseases caused by or characterized by any type of malignant tumor, including metastatic cancers, lymphatic tumors, and blood cancers. Exemplary cancers include, but are not limited to, cancers of the bladder, brain, breast, bone marrow, cervix, colon/rectum, kidney, liver, lung/bronchus, ovary, pancreas, prostate, skin, stomach, thyroid, or uterus.

As used herein, "intravenous administration" refers to delivery of a therapeutic directly into a vein.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, normal levels or values can be defined in a variety of ways known to one of skill in the art. Typically, normal levels refer to the expression levels of a marker (e.g. adenosine, ADR or nucleosidase) across a healthy population. The normal levels (or reference levels) are based on measurements of healthy subjects, such as from a specified source (i.e., blood, serum, tissue, or other source). Often, a normal level will be specified as a "normal range", which typically refers to the range of values of the median 95% of the healthy population. Reference value is used interchangeably herein with normal level but can be different from normal levels depending on the subjects or the source. Reference levels are typically dependent on the normal levels of a particular segment of the population. Thus, for purposes herein, a normal or reference level is a predetermined standard or control by which a test patient can be compared.

As used herein, elevated level refers to the any level of amount or expression of a marker above a recited or normal threshold.

As used herein, biological sample refers to any sample obtained from a living or viral source or other source of macromolecules and biomolecules, and includes any cell type or tissue of a subject from which nucleic acid or protein or other macromolecule can be obtained. The biological sample can be a sample obtained directly from a biological source or to sample that is processed. For example, isolated nucleic acids that are amplified constitute a biological sample. Biological samples include, but are not limited to, body fluids, such as blood, plasma, serum, cerebrospinal fluid, synovial fluid, urine and sweat, and tissue and organ samples from animals, including biopsied tumor samples.

As used herein, detection includes methods that permit visualization (by eye or equipment) of a protein or marker. A protein can be visualized using an antibody specific to the protein. Detection of a protein can also be facilitated by fusion of a protein with a tag including an epitope tag or label.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, a pharmaceutically effective agent includes any therapeutic agent or bioactive agents, including, but not limited to, for example, chemotherapeutics, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms or, adverse effects of a condition, such as, for example, reduction of adverse effects associated with or that occur upon administration of an ADA2, such as a variant ADA2.

As used herein, prevention or prophylaxis refers to reduction in the risk of developing a disease or condition.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, the term "subject" refers to an animal, including a mammal, such as a human being. The subject can include any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal.

As used herein, a patient refers to a human subject exhibiting symptoms of a disease or disorder.

As used herein, about the same means within an amount that one of skill in the art would consider to be the same or to be within an acceptable range of error. For example, typically, for pharmaceutical compositions, within at least 1%, 2%, 3%, 4%, 5% or 10% is considered about the same. Such amount can vary depending upon the tolerance for variation in the particular composition by subjects.

As used herein, the singular forms "a," "an" and "the" include plural referents unless the context clearly dictates otherwise. Thus, for example, reference to a compound comprising or containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. ADENOSINE DEAMINASE 2 (ADA2) AND MODULATION OF ADENOSINE-MEDIATED TUMOR IMMUNOSUPPRESSION

Provided herein are methods of treating diseases or conditions such as a cancer or a tumor by administering any Adenosine Deaminase 2 (ADA2) protein, including variants or conjugates thereof, to a subject. Extracellular adenosine is responsible for the regulation of critical biological processes, such as immunomodulation (Blay, J. (2012) *Encyclopedia of Cancer* pp. 49-52). In pathophysiological conditions such as the tumor microenvironment (TME), extracellular adenosine concentration rapidly increases in certain parts of the TME, generating an immunosuppressive niche that promotes tumor growth. ADA2 modulates adenosine levels in the extracellular environment, thereby affecting adenosine signaling and adenosine-dependent immunosuppression. ADA2 can decrease the extracellular adenosine levels by converting adenosine to inosine, to overcome the immunosuppressive effects in the TME. For example, as shown herein, administration of ADA2 can reverse the adenosine-dependent immunosuppression and can reduce tumor growth in vivo.

1. Tumor Immunity and Immune Evasion

Cancerous cells contain tumor-specific antigens that are recognized by the immune system. In tumor immunity, the goal of the immune system is to attack and eradicate these cancerous cells through the actions of immune cells, including cytotoxic T cells, Natural Killer (NK) cells and macrophages. For example, CD4+ and CD8+ T cells can become activated upon recognition of antigenic peptides presented on antigen-presenting cells on major histocompatibility complex (MHC) class I or class II molecules, respectively. Activated CD8+ cells, or cytotoxic T cells, can kill tumor cells expressing the antigen, which can be helped by the presence of CD4+ T cells. In addition to the direct killing effects of cytotoxic T cells, T cells also produce various cytokines and chemokines that can recruit other effector immune cells, such as neutrophils, macrophages or NK cells to the tumor microenvironment. NK cells also can directly kill cancer cells.

Studies have demonstrated that the immune system can prevent tumor growth. For example, immunodeficient mice develop more cancers than wild-type mice (Dunn et al. (2004) *Immunity*, 21:137-48). Lymphocytes and IFN-gamma have been shown to collaborate to prevent the formation of carcinogen-induced sarcoma and spontaneous epithelial carcinomas (Shankaran et al. (2001) *Nature*, 410: 1107-1111). Further, gene-targeted and lymphocyte subset-depleted mice have demonstrated a role for NK cells in tumor rejection. For example, mice depleted for both NK and NK1.1+ T cells were found to have increased susceptibility to tumor formation compared to control mice, and a similar result was observed upon treatment of mice with antisialo-GM1, which selectively eliminates NK cells (Smyth et al. (2001) *Int Immunol.*, 13; 459-63). In addition, the number, type and location of tumor immune infiltrates in primary tumors are prognostic factors for survival of cancer in human patients (Pages et al. (2005) *N Engl J Med*, 353:2654-2666).

Most tumors, however, can evade the immune system. The tumor microenvironment is complex, and includes a variety of immunosuppressive mechanisms that can be intrinsic to tumor cells or mediated by other cells or molecules. Through these mechanisms, alone or in combination, the immune system can promote tumor progression. These mechanisms include, but are not limited to, eliminating tumor cell antigens that elicit immune response; preventing or downregulating the expression of ligands required for immune activation, such as major histocompatibility complex class I (MHC I); production of immunosuppressive mediators, such as interleukin-10 (IL-10), transforming growth factor-β or adenosine; recruitment of immune cell subsets that suppress effector immune cell function, such as T regulatory cells (Tregs) or myeloid-derived suppressor cell (MDSC); or the upregulation of checkpoint inhibitors, such as cytotoxic T-lymphocyte antigen 4 (CTLA4), that can attenuate effector T-cell function. For example, adenosine is a prominent immunosuppressive agent in the tumor microenvironment.

2. Adenosine Immunomodulation in Cancer and Tumor Microenvironment (TME)

Adenosine (adenine-9-β-D-ribofuranoside; Ado) is a nucleoside that exists as a part of adenine nucleotides (AMP, ADP, and ATP) which participate widely in cellular energy metabolism and act as precursor molecules in many processes. Adenosine can exist in the free form both inside and outside of cells.

Adenosine is an important in vivo signaling molecule, especially for the immune system. In particular, adenosine is a well-known effector of immune function. In T-cells, adenosine decreases T-cell receptor induced activation of NF-κB, and inhibits IL-2, IL-4, and IFN-γ. Adenosine decreases T-cell cytotoxicity, increases T-cell anergy, and increases T-cell differentiation to Foxp3$^+$ or Lag-3$^+$ regulatory T cells. Adenosine decreases IFN-γ production by NK cells and suppresses NK cell cytotoxicity. Adenosine blocks neutrophil adhesion and extravasation, decreases phagocytosis, and attenuates levels of superoxide and nitric oxide. Adenosine also decreases the expression of TNF-α, IL-12, and MIP-1α on macrophages, attenuates MHC Class II expression, and increases levels of IL-10 and IL-6. In addition, adenosine decreases phagocytosis and superoxide and nitric oxide levels on macrophages (Stagg and Smyth (2010) *Oncogene* 29:5346-5358).

FIG. 2 sets forth the biosynthesis and catabolism of adenosine. Extracellular adenosine is produced by the sequential activities of membrane associated ectoenzymes, CD39 and CD73, which together produce adenosine by phosphohydrolysis of ATP or ADP produced from dead or dying cells. CD39 (also called ectonucleoside triphosphate diphosphohydrolase; SEQ ID NO:542) converts extracellular ATP (or ADP) to 5'AMP. Then, CD73 (also called 5'nucleotidase; SEQ ID NO:543) converts 5'AMP to adenosine. The activity of CD39 is reversible by the actions of NDP kinase and adenylate kinase, whereas the activity of CD73 is irreversible. CD39 and CD73 are expressed on tumor stromal cells, including endothelial cells and Tregs, and also on many cancer cells. For example, the expression of CD39 and CD73 on endothelial cells is increased under the hypoxic conditions of the tumor microenvironment. Tumor hypoxia can result from inadequate blood supply and disorganized tumor vasculature, impairing delivery of oxygen (Carroll and Ashcroft (2005), Expert. Rev. Mol. Med. 7(6): 1-16). Hypoxia also inhibits adenylate kinase (AK), which converts adenosine to AMP, leading to very high extracellular adenosine concentration. Thus, adenosine is released at high concentrations in response to hypoxia, which is a condition that frequently occurs the tumor microenvironment (TME), in or around solid tumors.

Thus, while the concentration of adenosine is typically low in the tissues and blood, the local adenosine concentration can increase significantly as a result of damage or stress, e.g., inflammation, ischemia, and hypoxia. For example, the extracellular concentration of adenosine in the hypoxic tumor microenvironment can be up to 10 μM adenosine, which is up to about 100-fold higher than the typical extracellular adenosine concentration of approximately 0.1 μM (Antonioli et al. (2013) Nat Rev Can 13:842-857). Since the hypoxic regions in tumors are centered around the microvessels, the local concentration of adenosine in regions of the tumor can actually be higher.

Adenosine immunomodulation activity occurs after its release into the extracellular space of the tumor and activation of adenosine receptors (ADRs) on the surface of target immune cells, cancer cells or endothelial cells. There are four types of ADRs, $A_1$ (SEQ ID NO:533), $A_{2A}$ (SEQ ID NO:534), $A_{2B}$ (SEQ ID NO:535) and $A_3$ (SEQ ID NOS:536-538), which are each G-protein coupled receptors with different affinity for adenosine and different downstream signaling pathways. Activation of the $A_1$ and $A_3$ receptors decrease intracellular cyclic AMP (cAMP) levels, and the activation of $A_{2A}$ and $A_{2B}$ receptors increase cAMP levels through the activation of adenylyl cyclase. Each of the $A_1$, $A_{2A}$, and $A_3$ can be activated at physiological concentrations of adenosine (e.g. 30-300 nM), but $A_{2B}$ has a lower affinity for adenosine and requires higher levels of adenosine for activation (Stagg et al. (2010) Oncogene, 29:5346-5358). The result of activation of the ADRs differs depending on the cell type and the receptor type: it can lead to activation or suppression of cell function and cell death (Antonioli et al. (2013) Nat Rev Can 13:842-857). All four types of receptors can exist on cells in the tumor microenvironment, including on cancer cells, stromal cells, endothelial cells, and inflammatory and immune cells, and all can be activated at adenosine concentrations present in the tumor microenvironment.

The high adenosine levels in the tumor microenvironment results in local immunosuppression, which limits the capacity of the immune system to eliminate cancer cells. For example, adenosine can suppress various functions of T lymphocytes, natural killer (NK) cells, polymorphonuclear granulocytes, and phagocytic cells such as tissue macrophages. In particular, the $A_{2A}$ receptor is known to be expressed on monocytes, macrophages, mast cells, granulocytes, lymphocytes, dendritic cells (DCs), NK cells and endothelial cells, and its expression on many cell types is induced by hypoxia (Stagg and Smyth (2010) Oncogene, 29:5346-5358). Activation of $A_{2A}$ has been shown to suppress NK cell functions, inhibit T-cell proliferation, inhibit T cell cytotoxicity and cytokine production, and inhibit macrophage activation (Stagg and Smyth (2010); Antonioli et al. (2013)). Activation of $A_{2B}$ has been shown to suppress DC differentiation to limit T cell activation and to promote expansion and accumulation of MSDC (Stagg and Smyth (2010); Antonioli et al. (2013)).

In addition to direct effects to inhibit the immune system, adenosine also can control cancer cell growth and dissemination by effects on cancer cell proliferation, apoptosis and angiogenesis. For example, adenosine can promote angiogenesis, primarily through the stimulation of $A_{2A}$ and $A_{2B}$ receptors. Stimulation of the receptors on endothelial cells can regulate the expression of intercellular adhesion molecule 1 (ICAM-1) and E-selectin on endothelial cells, maintain vascular integrity, and promote vessel growth (Antonioli et al. (2013)). In addition, activation of one or more of $A_{2A}$, $A_{2B}$ or $A_3$ on various cells by adenosine can stimulate the production of the pro-angiogenic factors, such as vascular endothelial growth factor (VEGF), interleukin-8 (IL-8) or angiopoietin 2 (Antonioli et al. (2013)).

Adenosine also can directly regulate tumor cell proliferation, apoptosis and metastasis through interaction with receptors on cancer cells. For example, studies have shown that the activation of $A_1$ and $A_{2A}$ receptors promote tumor cell proliferation in some breast cancer cell lines, and activation of $A_{2B}$ receptors have cancer growth-promoting properties in colonic carcinoma cells (Antonioli et al. (2013)). Adenosine also can trigger apoptosis of cancer cells, and various studies have correlated this activity to activation of the extrinsic apoptotic pathway through $A_3$ or the intrinsic apoptotic pathway through $A_{2A}$ and $A_{2B}$ (Antonioli et al. (2013)). In addition, adenosine can promote tumor cell migration and metastasis, by increasing cell motility, adhesion to the extracellular matrix, and expression of cell attachment proteins and receptors to promote cell movement motility.

3. Adenosine Deaminase and Targeting Adenosine in Treatment of Cancer

The levels of adenosine can be regulated by the actions of adenosine deaminase (ADA), which is an enzyme that converts adenosine to inosine or 2'-deoxyadenosine to 2'-deoxyinosine. In particular, ADA converts either adenosine or deoxyadenosine, in the presence or water, into inosine or dexoyinosine and ammonia as follows: adenosine+$H_2O$=inosine+$NH_3$ or 2'-deoxyadenosine+$H_2O$=2'-deoxyinosine+$NH_3$. The increase in ammonia in the local tumor microenvironment can increase the pH.

There are two types of ADA in humans, ADA1 and ADA2. ADA1 is ubiquitously present inside cells, and exhibits a similar binding affinity for adenosine and 2'deoxyadenosine with a Km of about $5.2 \times 10^{-5}$ M. ADA1 principally functions intracellularly, to reduce the levels of adenosine that can be toxic to cells, such as lymphocytes. For example, deficiency of adenosine deaminase 1 (ADA1) is associated with mild immunodeficiency to severe combined immunodeficiency (SCID), due to the toxic accumulation of adenosine in immature lymphoid cells, thereby resulting in apoptotic death of lymphocytes and a profound depletion of T, B, and NK cells (Hershfield, M. S. (2005)

Eur. J. Immunol. 35:25-30). In contrast, ADA2 contains a secretion signal sequence, and is the predominant extracellular ADA. The majority of ADA activity in normal human serum or plasma are from ADA2 (Neidzwicki and Aberneth (1991) *Biochemical Pharmacology* 41:1615-1624). ADA2 has a much lower binding affinity for adenosine with a Km of about $200 \times 10^{-5}$ M, and exhibits even weaker affinity for 2'deoxyadenosine. Also, unlike ADA1, ADA2 has an acidic pH optimum.

Decreasing the tumor-specific accumulation of adenosine in the TME is an attractive therapeutic option for treating tumors and cancers. It is found herein that recombinant forms of ADA2 can be administered to a subject to selectively target the TME, where it can decrease the extracellular adenosine levels by deaminating adenosine to inosine, thereby reversing the immunosuppressive effect of adenosine. In particular, ADA2 is an extracellular adenosine deaminase adapted for high adenosine concentrations. As discussed above, adenosine is actively produced in the TME, and regions of the TME can have up to about a 100-fold higher adenosine concentration than other tissue environments. Because of the hydrophobic subpocket for substrate binding, discussed further below, the $K_m$ of ADA2 for adenosine is approximately 100 times higher than that of ADA1. The turnover rate ($k_{cat}$), however, is similar to that of ADA1. Because ADA2 has a similar turnover rate but a lower affinity to adenosine, it can be specifically active in environments with high adenosine concentrations, such as the TME or site of inflammation, without affecting adenosine metabolism in normal microenvironments that have lower adenosine concentrations.

The results herein demonstrate that recombinant ADA2 is selectively targeted to the tumor environment. In addition, results provided herein confirm that adenosine-mediates immunosuppression in T cells and NK cells, and that this suppression can be reversed by administered adenosine deaminase 2 (ADA2). The selective activity of ADA2 for decreasing adenosine levels in the TME can limit undesired or unwanted side effects, which can occur if the activity of ADA2 were more ubiquitous. For example, many existing tumor therapeutics are limited because they can result in adverse side effects in the subject due to lack of specificity or selectivity. The use of ADA2, or variants or conjugates thereof, in methods provided herein can result in fewer or lesser undesirable side-effects and/or exhibit improved efficacy by virtue of the ability to dose higher.

Thus, ADA2 offers advantages compared to ADA1. In addition to differences in binding affinity for adenosine that permits the use of ADA2 as a selective tumor-targeting molecule, ADA1 also is not adapted for use in an extracellular environment. For example, ADA1 is primarily intracellular in vivo and is substantially less stable in the extracellular environment, such as in the plasma, as shown in the results provided herein. In contrast, ADA2 shows increased stability in the extracellular environment due to the extensive glycosylation that protect the molecule from proteolysis in the extracellular environment and conserved disulfide bonds. ADA2 also is substantially more stable at higher temperature compared to ADA1 (Daddona and Kelley (1981) Biochim. Biophys. Acta 658:280-290). It is found herein that ADA2 has a higher thermal stability, and that ADA2 is also more stable than ADA1 in extracellular environments, such as the plasma.

ADA2 also shows optimal activity in environments commonly found in the TME, such as environments having an acidic pH. For example, the optimal pH of wildtype ADA2 is approximately pH 6.5, whereas it is pH 7.5 for ADA'. The TME is a complex microenvironment in and surrounding the tumor that is made of diverse cell types and extracellular conditions. The TME commonly has regions where the extracellular environment is acidic, caused by lactic acid and other acidic metabolites produced by anaerobic glycolysis in hypoxic conditions of the tumor (Kato et al. (2013) Cancer Cell International 13:89).

In addition, ADA2 also overcomes other problems encountered with existing therapeutics, including those that target adenosine. For example, since adenosine has multiple receptors, it is difficult to target adenosine using an anti-ADR antibody, since all four ADR receptors are present in the TME and can be activated by adenosine. Hence, targeting of a single receptor would not achieve complete attenuation of adenosine immunomodulation activity.

Thus, the methods provided include methods of treatment using any ADA2, for example recombinant human ADA2 (rHuADA2) or variants and/or conjugates thereof, for treatment of diseases or conditions, such as a cancer or a tumor and other diseases or conditions involving aberrant or accumulated production of adenosine. Also provided herein are ADA2 variants and modified forms that possess altered properties, such as decreased heparin binding, increased catalytic efficiency, increased stability, altered glycosylation state and/or altered pH optimum. Any of the ADA2 proteins can be used in the methods of treatment provided herein. Also provided herein are methods of combination therapy using any ADA2 and other immunomodulatory agents, chemotherapeutic agents, immune checkpoint inhibitors or hyaluronan-degrading enzyme, such as a soluble hyaluronidase or polymer-conjugated soluble hyaluronidase (e.g. PEGPH20).

C. ADENOSINE DEAMINASE 2 (ADA2) AND VARIANTS THEREOF

Provided herein are methods of treatment using an adenosine deaminase 2 (ADA2), including wildtype human ADA2, ADA2 variants and/or conjugates or other modified forms thereof. Also provided herein are variants of ADA2 with altered properties. ADA2 can be used to regulate adenosine levels in environments where regulation of adenosine-dependent immunomodulation or other adenosine-dependent activity is needed, such as in a tumor microenvironment or for inflammation.

1. Structure and Activity of ADA2

Adenosine deaminases are enzymes that convert adenosine to inosine. There are three known ADAs: ADA1, ADA2 and ADA3, although the activity of ADA3 is not known. With respect to proteins with known adenosine deaminase activity, humans have both ADA2 and ADA1, whereas in flies, homologues of ADA2 (known as ADGF homologues) are the only active adenosine deaminase enzymes, and rodents only have ADA1, indicating that the two proteins have overlapping yet also distinct functions. Distinct functions relate to the difference in expression, cellular location and kinetic properties of the enzymatic activity, difference in other structural features, as well as the additional growth factor and heparin binding properties (Zavialov et al. (2010) J. Biol. Chem. 285:12367-12377).

ADA1 and ADA2 are structurally similar, and exhibit a shared catalytic mechanism to convert adenosine to inosine, but exhibit little sequence similarity. ADA2 has a nucleotide sequence set forth in SEQ ID NO:1, which encodes a 511 amino acid protein, set forth in SEQ ID NO:2, that contains a signal sequence (corresponding to amino acid residues 1-29 of SEQ ID NO:2). Mature ADA2 is a secreted protein that lacks the signal sequence and has the sequence of amino acids set forth in SEQ ID NO:5. ADA1 has a nucleotide sequence set forth in SEQ ID NO:11, which encodes a 363 amino acid protein that does not contain a signal sequence, and has the sequence of amino acids set forth in SEQ ID NO:12. The N-terminal methionine residue is cleaved, resulting in the mature 362 amino acid protein, set forth in SEQ ID NO:66.

As discussed in more detail below, compared to ADA1, ADA2 is considerably longer and includes an 80-100-amino acid extension at the N terminus that is involved in dimerization and glycosaminoglycan (e.g. heparin) binding (Maier et al. (2005) Mol Evol 61:776-794). ADA2 also has an additional putative receptor binding (PRB) domain that is reported to mediate binding to cell surface receptors and/or contribute to its growth factor or other signaling functions. Also, unlike ADA1, ADA2 is dimeric and secreted, whereas ADA1 is monomeric and largely intracellular. ADA2 also is extensively glycosylated and has a conserved disulfide bond. The structural and functional features of ADA2 offer advantages as a therapeutic molecule, including, but not limited to, greater stability and increased tumor selectivity.

a. Structure of ADA2

ADA2, also known as dendritic cell derived growth factor (DCDGF) or adenosine deaminase growth factor (ADGF), is a member of the adenosine ADGF family of proteins. ADA2 is found only in eukaryotes, and primarily in multicellular organisms. In contrast, ADA1 is found in both prokaryotes and eukaryotes. In particular ADA2/ADGF homologs, have been characterized in insects and other vertebrates such as *Xenopus laevis*, as well as in humans. ADGF family proteins in insects were initially identified as proteins having growth factor activity, and later found to also possess adenosine deaminase activity.

In humans, ADA2 is encoded by the cat eye syndrome critical region gene 1 (CECR1) gene (Riazi et al. (2000) Genomics 64:277-285). The human CECR1 gene (nucleotide sequence of the coding region set forth in SEQ ID NO:1) encodes a 511 amino acid precursor protein (sequence set forth in SEQ ID NO:2; Uniprot Accession No. Q9NZK5). ADA2 has an N-terminal 29 residue signal sequence (amino acid residues positions 1-29 of SEQ ID NO:2) that is cleaved following transport to the ER to form the 482 amino acid mature protein (sequence set forth in SEQ ID NO:5). The mature ADA2 protein exists as a homodimer due to nonpolar interactions between two polypeptide chains. Other sequences of human ADA2 also have been reported, see e.g. U.S. Pat. No. 5,968,780 (precursor form SEQ ID NO:376 and mature form SEQ ID NO:380), NCBI Acc. No. BAG369969.1 (precursor form SEQ ID NO:377 and mature form SEQ ID NO:381); NCBI Acc. No. AAF65941 (precursor form SEQ ID NO:378 and mature form SEQ ID NO:382); and NCBI Acc. No. AAH51755 (precursor form SEQ ID NO:379 and mature form SEQ ID NO:383). A non-canonical second isoform, formed by alternative splicing of the mRNA, encodes a shorter protein of 270 amino acids (sequence set forth in SEQ ID NO:68; Uniprot Accession No. Q9NZK5-2), missing the N-terminal 241 amino acids and containing a 10-amino acid sequence in the N-terminus that is different from the canonical isoform.

Exemplary ADA2 homologs in other species include, but are not limited to, ADA2 from *Pan troglodytes* (chimpanzee; precursor form SEQ ID NO:286, mature form SEQ ID NO:326; NCBI Acc. No. XP_003317127.1); *Gorilla gorilla* (gorilla; precursor form SEQ ID NO:287, mature form SEQ ID NO:327; NCBI Acc. No. XP_004063024.1); *Pan paniscus* (pygmy chimpanzee; precursor form SEQ ID NO:288, mature form SEQ ID NO:328; NCBI Acc. No. XP_003828345.1); *Pongo abelii* (Sumatran orangutan; precursor form SEQ ID NO:289, mature form SEQ ID NO:329; NCBI Acc. No. NP_001125360.1); *Nomascus leucogenys* (Northern white-cheeked gibbon; precursor form SEQ ID NO:290, mature form SEQ ID NO:330; NCBI Acc. No. XP_004088517.1); *Macaca fascicularis* (crab-eating macaque; precursor form SEQ ID NO:291, mature form SEQ ID NO:331; NCBI Acc. No. XP_005568111.1); *Chlorocebus sabaeus* (green monkey; precursor form SEQ ID NO:292, mature form SEQ ID NO:332; NCBI Acc. No. XP_007972990.1); *Macaca mulatta* (Rhesus macaque; precursor form SEQ ID NOS:293, 337, mature form SEQ ID NOS:333, 340; GenBank Acc. Nos. AFH32795.1, EHH20002.1); *Callithrix jacchus* (marmoset; precursor form SEQ ID NOS:294, 374, mature form SEQ ID NO:334, 375; NCBI Acc. No. XP_009004591.1, XP_009004586.1); *Xenopus laevis* (African clawed frog; precursor form SEQ ID NO:295, mature form SEQ ID NO:335; NCBI Acc. No. NP_001090531.1); *Drosophila melanogaster* (fruit fly; precursor form SEQ ID NOS:296-300, mature form SEQ ID NOS:336, 338, 339; AAL40913.1, AAL40920.1, AAL40911.1, AAL40912.1, and AAL40910.1); *Bombyx mori* (silk moth; precursor form SEQ ID NO:301, mature form SEQ ID NO:341; NCBI Acc. No. NP 001098698.1); and *Sarcophaga perigrina* (flesh fly; precursor form SEQ ID NO:302, mature form SEQ ID NO:342; GenBank Acc. No. BAA11812.1).

The domain organization of ADA2 is described in Zavialov et al. (2010) J. Biol. Chem. 285:12367-12377. ADA2 contains a core ADA domain or catalytic domain that makes up more than 70% of the amino acid sequence, and is structurally similar to the ADA domain in ADA1. In the monomer, the ADA domain is folded into eight strands of parallel α/β barrels, which surround a central deep pocket that is the active site. In addition, the ADA domain also contains three additional helices located between the β1 strand and the α1 helix (designated H1, H2 and H3) and two additional helices at the C terminus (designated H4 and H5). The ADA domain is contained in the region corresponding to residues 106-502 of the precursor ADA2 set forth in SEQ ID NO:2 (corresponding to residues 77-473 of the mature ADA2 set forth in SEQ ID NO:5). In the ADA region, ADA2 contains insertions of amino acid residues compared to ADA1, including residues that make up the putative receptor-binding (PRB) domain (discussed below), and which are not involved in the catalytic function of ADA2. The ADA domain does not have high sequence homology with that of ADA1 (18-21% identical residues), but the two ADA domains have high structural similarity. Table 4 summarizes the residues in the active site involved in substrate binding and catalysis.

TABLE 4

| Residue (numbering of precursor set forth in SEQ ID NO: 2) | Active Site |
|---|---|
| 112 | $Zn^{2+}$ coordination, catalytic |
| 114 | $Zn^{2+}$ coordination, catalytic |
| 115 | substrate binding |
| 116 | substrate binding |
| 204 | substrate binding |
| 207 | substrate binding |
| 208 | substrate binding |
| 211 | substrate binding |
| 293 | substrate binding |
| 325 | substrate binding |

TABLE 4-continued

| Residue (numbering of precursor set forth in SEQ ID NO: 2) | Active Site |
|---|---|
| 326 | substrate binding |
| 356 | $Zn^{2+}$ coordination, catalytic |
| 359 | active site proton donor, substrate binding |
| 384 | active site proton acceptor, substrate binding |
| 415 | substrate binding |
| 441 | $Zn^{2+}$ coordination, catalytic, substrate binding |
| 442 | substrate binding |

Based on the crystal structure as reported in Zavialov et al. (2010) J. Biol. Chem. 285:12367-12377 of ADA2 with coformycin (CF), a transition state inhibitor that mimics the tetrahedral intermediate at the C6 position of adenine, residues involved in substrate binding have been identified. These include residues D115, I116, W204, F207, E208, F211, H293, V325, G326, E359, H384, L415, D441, and D442 of precursor ADA2 set forth in SEQ ID NO:2 (corresponding to residues D86, I87, W175, F178, E179, F182, H254, V296, G297, E330, H355, L386, D412 and D413 of mature ADA2 set forth in SEQ ID NO:5). Although the structural features of the catalytic site are similar between ADA2 and ADA1, the hydrophobic substrate-binding sub-pocket in the ADA domain of ADA2 is more open and contains fewer hydrophobic residues. These differences could account for the lower affinity of ADA2 for adenosine.

ADA2 is a zinc-dependent hydrolase that requires coordination with a bound zinc for activity, which acts as a powerful electrophile activating the attacking water to a hydroxide ion. Amino acid residues H112, H114, H356 and D441 of precursor ADA2 set forth in SEQ ID NO:2 (corresponding to H83, H85, H327, D412 of mature ADA2 set forth in SEQ ID NO:5) are involved in coordinating the zinc active center. During catalysis, the $Zn^{++}$ promotes nucleophilic attack on the carbonyl carbon by the oxygen atom of a water molecule at the active site. The combination of E359, H384 and D441 of precursor ADA2 set forth in SEQ ID NO:2 (corresponding to E330, H355 and D412 of mature ADA2 set forth in SEQ ID NO:5) participate as zinc ligands. H384 and D441 position the attacking water, E359 is the active site catalytic proton donor residue that facilitates the reaction by extracting a proton from the attacking water molecule, and H384 serves as the proton acceptor. The catalytic active site residues structurally mirror the corresponding active site residues of ADA1, indicating that the catalytic mechanism is similar between the two adenosine deaminases (Zavialov et al. (2010) J. Biol. Chem. 285: 12367-12377).

Active ADA2 exists as a homodimer. Dimerization of ADA2 is mediated by residues in the N-terminal α-helices of ADA2 designated HN1, HN2, HN3 and HN4 (corresponding to residues 29-105 of precursor ADA2 set forth in SEQ ID NO:2, or residues 1-76 of mature ADA2 set forth in SEQ ID NO:5), as well as residues in the C-terminal α-helix designated H5 (corresponding to residues 503-511 of precursor ADA2 set forth in SEQ ID NO:2 or residues 474-482 of mature ADA2 set forth in SEQ ID NO:5). Because these regions are responsible for more than 70% of the nonpolar intersubunit interaction, they are designated the dimerization domain. The first N-terminal helix, HN1, forms a helix anchor due to ionic interactions between residues R34 and E41 (residues R5 and E12 of mature ADA2 set forth in SEQ ID NO:5) with D373 and H391 (residues D344 and H362 of mature ADA2 set forth in SEQ ID NO:5) of the neighboring subunit, and hydrophobic interactions between residues I30, T33, L37, L38, K40 and M44 (residues I1, T4, L8, L9, K11 and M15 of mature ADA2 set forth in SEQ ID NO:5) with residues in the neighboring subunit. A hydrophobic binding pocket is formed with residues M71, A74, M75, L78 and F80, which accommodates the W336 (residues M42, A45, M46, L49 and F51 of mature ADA2 set forth in SEQ ID NO:5) residue from the neighboring subunit.

ADA1, which does not form a dimer, does not contain the residues that make up the "dimerization domain." Also, compared to ADA1, residue W336 in ADA2 is inserted into a region of the active site between β5 and α5, where it indirectly contributes to catalytic activity due to its involvement in dimerization. Substitution W336G results in an ADA2 molecule that partly dissociates into monomers, and which exhibits altered catalytic activity (Zavialov et al. (2010) J. Biol. Chem. 285:12367-12377). In addition to affecting full enzymatic activity, dimerization also is involved in the secretion of ADA2. Deletion of amino acids T33 and E41 (corresponding to T4 and E12 of mature ADA2 set forth in SEQ ID NO:5) abolishes secretion of ADA2 into the culture medium (Zavialov et al. (2010) J. Biol. Chem. 285:12367-12377).

ADA2 binds glycosaminoglycans (GAGs), including heparin and its analogs, such as heparan sulfate, and chondroitin sulfate. Protein dimerization results in a large, highly positively charged surface at the interface of dimer, which forms the GAG-binding site (Zavialov et al. (2010) J. Biol. Chem. 285:12367-12377). In particular, the GAG-binding site involves amino acid residues near positions I30-R45, S389-T396 and R422-T428 of precursor ADA2 (corresponding to I1-R16, S360-T367, and R393-T399 of mature ADA2 set forth in SEQ ID NO:5). The interaction with GAGs appears to play a role in stabilizing the ADA2 dimer.

ADA2 has an insertion sequence within the catalytic domain, designated the putative receptor-binding (PRB) domain, which is reported to correspond to residues 127-185 or 134-177 of precursor ADA2 set forth in SEQ ID NO:2 (positions 98-156 or 105-148, respectively, of mature ADA2 set forth in SEQ ID NO:5). The PRB domain folds into a chemokine-like domain made up of an α- and β-fold composed of a three-stranded antiparallel β-sheet surrounded by α-helices on one side and a proline-rich loop on the other side. A disulfide bond between positions 137 and 159 of precursor ADA2 (positions 108 and 130 of mature ADA2 set forth in SEQ ID NO:5) is present in the PRB domain, which is required for ADA2 secretion and structural stability. The crystal structure of ADA2 shows that the PRB domain, while not involved in the catalytic function of ADA2, sits on the top of the adenosine deaminase (ADA) domain at the edge of the active site. When ADA2 dimerizes, the two PRB domains in the dimer are present on the same side of the dimer, and could bind dimeric receptors or induce receptor dimerization (Zavialov et al. (2010) J. Biol. Chem. 285: 12367-12377; Zavialov et al. (2010) J. Leukoc. Biol. 88:279-290). ADA2 binds adenosine receptors (ADRs) which are dimeric receptors. The PRB domain is implicated in its growth factor activity through the receptor binding activity (Zavialov et al. (2010) J. Biol. Chem. 285:12367-12377; Zavialov et al. (2010) J. Leukoc. Biol. 88:279-290). Thus, elimination or modification of this domain can reduce, attenuate or eliminate this activity.

ADA2 has four (4) native N-linked glycosylation sites, at N127, N174, N185 and N378 of precursor ADA2 (corresponding to N98, N145, N156 and N349 of mature ADA2 set forth in SEQ ID NO:5). Three N-glycosylation sites are present in the PRB domain, at N127, N174, and N185, and one is present on the opposite side of the molecule, at N378.

The oligosaccharide chains located on three different faces of the ADA2 molecule protects the enzyme against proteolysis in the extracellular environment, providing increased stability (Zavialov et al. (2010) J. Biol. Chem. 285:12367-12377).

b. Activities of ADA2

ADA2 has several activities. ADA2 has adenosine deaminase (ADA) activity, which catalyzes adenosine to inosine (adenosine+$H_2O$=inosine+$NH_3$) and 2'-deoxyadenosine to 2'-deoxyinosine (2'-deoxyadenosine+$H_2O$=2'-deoxyinosine+$NH_3$) reactions. Coformycin and 2'-deoxycoformycin are potent inhibitors of ADA1 and ADA2. Due to differences in the substrate binding pocket, however, the inhibitor (+)-erythro-9-(2-hydroxy-3-nonyl)adenine (EHNA) selectively inhibits ADA1, but does not inhibit ADA2. Also, the differences in the substrate binding pocket account for differences in substrate binding affinity between ADA1 and ADA2. For example, while the $k_{cat}$ values for adenosine are similar due to the high structural similarity of the catalytic residues in ADA2 and ADA1, the $K_m$ for adenosine are different. The $K_m$ of ADA2 for adenosine is approximately 2.25 mM. Because ADA2 has a hydrophobic subpocket for substrate binding, the affinity for ADA2 for substrates is different from that of ADA1. The $K_m$ of ADA2 for adenosine is approximately 100 times higher than that of ADA1, which is approximately 0.1 mM.

The optimal pH for activity of ADA2 is around pH 6.5, and its activity decreases at a pH higher than 7.0 In contrast, the optimal pH for ADA1 is around pH 7.5. Different substrate affinity and pH optimum indicate that ADA2 is adapted for specific microenvironments, and serve overlapping yet different functions in regulation of adenosine concentration and signaling (Zavialov et al. (2005) Biochem. J. 391:51-57). The acidic optimum pH for ADA2 and requirement for high adenosine concentration indicates that ADA2 can be active specific environments, such as sites of inflammation or tumors, where adenosine concentration is elevated and pH is lower. In the tumor microenvironment, tumor cells can undergo extensive glycolysis due to the hypoxic environment, and the extracellular microenvironment becomes acidic (pH 6.5-6.9) in certain regions.

In humans, ADA2 is widely expressed, with most abundant expression in adult heart, lung, lymphoblasts, and placenta as well as fetal lung, liver, and kidney. ADA2 is also detected in blood plasma at the protein level. The majority of ADA activity in normal human serum or plasma are from ADA2 (Neidzwicki and Aberneth (1991) Biochemical Pharmacology 41:1615-1624). ADA2 is secreted by activated cells, including activated monocytes and other immune cells, and to a more limited extent, by unstimulated lymphocytes (Iwaki-Egawa et al. (2006) Biol. Chem. 387:319-321). Immune cells, such as monocytes, are activated in inflammatory sites and tumors, where extracellular adenosine deaminase is accumulated (Sitkovsky et al. (2004) Annu. Rev. Immunol. 22:657-682). ADA2 could be involved in the regulation of adenosine levels in these specific environments (Zavialov et al. (2010) J. Leukoc. Biol. 88:279-290). For example, ADA2 could function to reduce the level of adenosine in environments with high adenosine concentrations, such as at inflammation sites or in the tumor microenvironment with hypoxic conditions.

ADA2 activity is elevated in plasma from patients suffering from liver diseases, such as chronic hepatitis and cirrhosis, AIDS, adult T-cell leukemia, acute lymphoblastic leukemia, tuberculosis and diabetes mellitus. (Zavialov et al. (2005) Biochem. J. 391:51-57). In addition, ADA2 levels are elevated in tuberculosis pleural effusion in recent *Mycobacterium tuberculosis* (MTB) infections (Valdez) or in visceral leishmaniasis (Tripathi et al., Clinica Chimica Acta 388 (2008) 135-138). The pleural effusion of MTB infection contain a high number of macrophages and CD4+ cells, indicating that ADA2 secretion by macrophages could modulate the immune response during MTB infection (Zavialov et al. (2010) J. Leukoc. Biol. 88:279-290).

ADA2 binds to the cell surface via GAG proteoglycans (e.g. heparin) and ADRs. Heparin analogs such as heparan sulfate proteoglycan (HSPG), or chondroitin sulfate (CS)-containing proteoglycans are present on the cell surface and are involved in protein localization and cell signaling. ADA2 can bind various types of cells via these heparin analogs, and the binding is tighter to a more highly sulfated heparin sulfate than to less sulfated heparin, indicating that the binding involves extensive ionic interaction. In contrast to ADA2, ADA1 does not bind to heparin (Zavialov et al. (2005) Biochem. J. 391:51-57, Zavialov et al. (2010) J. Biol. Chem. 285:12367-12377).

In addition to heparin analogs containing proteoglycans, ADA2 dimer binds to adenosine receptors (ADRs), which function as dimers (Zavialov et al. (2005) Biochem. J. 391:51-57, Zavialov et al. (2010) J. Biol. Chem. 285:12367-12377). ADA2 is reported to interact with cells to mediate growth factor activity. ADA2 can also directly bind to some dimeric adenosine receptors, stimulate proliferation of monocyte-activated CD4 T cells independently of its catalytic activity, induce T cell-dependent differentiation of monocytes into macrophages and stimulate macrophage proliferation. For example, ADA2 increases the rate of proliferation of monocyte-activated CD4 T cells independently of its catalytic activity, and induces T cell-dependent differentiation of monocytes into macrophages and stimulates macrophage proliferation (Zavialov et al. (2010) J. Leukoc. Biol. 88:279-290).

Defects or deficiencies in ADA2 have been associated with increased vascular inflammation and vasculopathy, in particular associated with Polyarteritis nodosa or Sneddon syndrome (Zhou et al. (2014) N. Engl. J. Med 370:911-920; Navon Elkan et al. (2014) N. Engl. J. Med 370:921-931; Garg et al. (2014) Eur. J. Pediatr 173:827-830; Bras et al. (2014) New Eng. J. Med., 371:479-48; Belot et al. (2014) Pediatric Rheumatology 12:44). For example, vasculitis is associated with recessive mutations in the gene encoding for ADA2 characterized by mutations G47A, G47R, G47V, A109D, H112Q, V119A, G142S, R169Q, P193L, P251L, W264S, Y453C with reference to precursor ADA2 set forth in SEQ ID NO:2 (Navon Elkan et al. (2014) N. Engl. J. Med 370:921-931; Zhou et al. (2014) N. Engl. J. Med 370:911-920; Bras et al. (2014) New Eng. J. Med., 371:479-480).

2. ADA2 Variants

Provided herein are variants or mutants of ADA2 containing a polypeptide that contains one or more amino acid modifications (i.e. changes in amino acid sequence) compared to a reference or unmodified ADA2. The modifications can be in any reference or unmodified ADA2 polypeptide, so long as the reference ADA2 does not already contain the amino acid change at the modified position(s). For example, the modification(s) can be in an ADA2 polypeptide that contains the sequence of amino acids set forth in any of SEQ ID NOS:5 or 326-336, 338-342, 375 or 380-383, a catalytically active fragment thereof or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS:5 or 326-336, 338-342, 375 or 380-383 or a catalytically active fragment thereof but does not contain the modification(s).

In particular examples, the modifications are in an ADA2 polypeptide set forth in SEQ ID NO:5, a catalytically active fragment thereof or in a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:5 or a catalytically active fragment thereof but does not contain the modification(s). For example, modifications can be in an ADA2 having a sequence of amino acids set forth in any of SEQ ID NOS:5, 326-334, 340, 375 or 380-383. Modifications also can be in a catalytically active portion of SEQ ID NO:5. For example, a catalytically active ADA2 can be one that lacks all or a portion of the PRB domain, such as those set forth in any of SEQ ID NOS:548-550 or 579. In particular examples, modifications are in a human ADA2 containing the sequence of amino acids set forth in SEQ ID NO:5.

In examples of a variant ADA2 polypeptide provided herein, the variant ADA2 does not have the sequence of amino acids set forth in any of SEQ ID NOS:1, 5, 68, 286-302, 326-342 or 374-383. Also, in examples herein, the variant ADA2 polypeptide does not contain modifications that are deletion R8-K14del→-- or that are an amino acid replacement H7R, G18A, G18R, G18V, I64T, A80D, H83Q, V90A, C108G, H121R, W133G, R140Q, K141R, P164L, P222L, W235S, H306R, E330G, W333G, V365L, Y424C, F464S, with numbering with reference to amino acid residues set forth in SEQ ID NO:5.

The variant ADA2 can be a monomer or can be a dimer, such as a heterodimer or a homodimer. The variant ADA2 polypeptides provided herein exhibit adenosine deaminase activity to catalyze the conversion of adenosine to inosine. It is understood that such activity is exhibited when the variant ADA2 polypeptide is in active form, such as when it is present as a dimer. Typically, such activity is present when the ADA2 is in dimer form. Hence, any of the variants provided herein can be used to regulate adenosine levels in environments where regulation of adenosine-dependent immunomodulation or other adenosine-dependent activity is needed, such as in a tumor microenvironment or for inflammation. Hence, any of the variants provided herein can be used in methods of treating tumor or cancer as described herein.

When in active form, such as when in dimer form, the variant ADA2 containing the variant ADA2 polypeptide can exhibit about 50% to 500%, such as about 50% to 400%, 50% to 300%, 50% to 200%, 50% to 150%, 50% to 100%, 50% to 80%, 80% to 400%, 80% to 300%, 80% to 200%, 80% to 150%, 80% to 100%, 100% to 400%, 100% to 300%, 100% to 200% or 100% to 150% of the adenosine deaminase activity compared to the corresponding form of the ADA2 polypeptide not containing the modification(s) (i.e. the unmodified ADA2), such as an ADA2 homodimer containing the sequence of amino acids set forth in SEQ ID NO:5, 326-334, 340, 375 or 380-383 or a catalytically active fragment thereof. For example, when in active form, such as when in dimer form, the variant ADA2 containing the variant ADA2 polypeptide can exhibit at least 50%, 60%, 70%, 75%, 80%, 85%, 90%, 95%, 100%, 110%, 120%, 130%, 140%, 150%, 160%, 170%, 180%, 190%, 200%, 210%, 220%, 230%, 240%, 250%, 260%, 270%, 280%, 290%, 300%, 350%, 400%, 450%, 500% or more of the adenosine deaminase activity compared to the corresponding form of the ADA2 polypeptide not containing the modification(s) (i.e. the unmodified ADA2), such as an ADA2 homodimer containing the sequence of amino acids set forth in SEQ ID NO:5, 326-334, 340, 375 or 380-383 or a catalytically active fragment thereof. Typically, a variant ADA2 containing a variant ADA2 polypeptide provided herein, when in dimer form, retains adenosine deaminase activity of the corresponding form of the ADA2 homodimer containing the sequence of amino acids set forth in SEQ ID NO:5 or a catalytically active fragment thereof, such that the variant ADA2, when in dimer form, exhibits at least 50%, 60%, 70%, 75%, 80%, 85%, 90%, 95%, 100%, 110%, 120%, 130%, 140%, 150%, 160%, 170%, 180%, 190%, 200%, 210%, 220%, 230%, 240%, 250%, 260%, 270%, 280%, 290%, 300%, 350%, 400%, 450%, 500% or more of the adenosine deaminase activity of the ADA2 homodimer containing the sequence of amino acids set forth in SEQ ID NO:5 or a catalytically active fragment thereof.

Typically, the catalytic efficiency or $k_{cat}/K_M$ ($M^{-1}$ $s^{-1}$) of variant ADA2 containing a variant ADA2 polypeptide provided herein is at least 5,000, such is generally from or from about $5 \times 10^3$ to $5 \times 10^6$, $5 \times 10^3$ to $2.5 \times 10^6$, $5 \times 10^3$ to $1 \times 10^6$, $5 \times 10^3$ to $5 \times 10^5$, $5 \times 10^3$ to $2.5 \times 10^5$, $5 \times 10^3$ to $1 \times 10^5$, $5 \times 10^3$ to $8 \times 10^4$, $5 \times 10^3$ to $5 \times 10^4$, $5 \times 10^3$ to $2.5 \times 10^4$, $5 \times 10^3$ to $1 \times 10^4$, $1 \times 10^4$ to $5 \times 10^5$, $1 \times 10^4$ to $2.5 \times 10^5$, $1 \times 10^4$ to $1 \times 10^5$, $1 \times 10^4$ to $8 \times 10^4$, $1 \times 10^4$ to $5 \times 10^4$, $1 \times 10^4$ to $2.5 \times 10^4$, $2.5 \times 10^4$ to $5 \times 10^6$, $2.5 \times 10^4$ to $2.5 \times 10^6$, $2.5 \times 10^4$ to $1 \times 10^6$, $2.5 \times 10^4$ to $5 \times 10^5$, $2.5 \times 10^4$ to $2.5 \times 10^5$, $2.5 \times 10^4$ to $1 \times 10^5$, $2.5 \times 10^4$ to $8 \times 10^4$, $2.5 \times 10^4$ to $5 \times 10^4$, $5 \times 10^4$ to $5 \times 10^6$, $5 \times 10^4$ to $2.5 \times 10^6$, $5 \times 10^4$ to $1 \times 10^6$, $5 \times 10^4$ to $5 \times 10^5$, $5 \times 10^4$ to $2.5 \times 10^5$, $5 \times 10^4$ to $1 \times 10^5$, $5 \times 10^4$ to $8 \times 10^4$, $8 \times 10^4$ to $5 \times 10^6$, $8 \times 10^4$ to $2.5 \times 10^6$, $8 \times 10^4$ to $1 \times 10^6$, $8 \times 10^4$ to $5 \times 10^5$, $8 \times 10^4$ to $2.5 \times 10^5$, $8 \times 10^4$ to $1 \times 10^5$, $1 \times 10^5$ to $5 \times 10^6$, $1 \times 10^5$ to $2.5 \times 10^6$, $1 \times 10^5$ to $1 \times 10^6$, $1 \times 10^5$ to $5 \times 10^5$, $1 \times 10^5$ to $2.5 \times 10^5$, $2.5 \times 10^5$ to $5 \times 10^6$, $2.5 \times 10^5$ to $2.5 \times 10^6$, $2.5 \times 10^5$ to $1 \times 10^6$, $2.5 \times 10^5$ to $5 \times 10^5$, $5 \times 10^5$ to $5 \times 10^6$, $5 \times 10^5$ to $2.5 \times 10^6$, or $5 \times 10^5$ to $1 \times 10^6$ $M^{-1}$ $s^{-1}$. For example, variant ADA2 containing a variant ADA2 polypeptide provided herein has a catalytic efficiency of $k_{cat}/K_M$ ($M^{-1}$ $s^{-1}$) of at least $5 \times 10^3$, $6 \times 10^3$, $7 \times 10^3$, $8 \times 10^3$, $9 \times 10^3$, $1 \times 10^4$, $2 \times 10^4$, $3 \times 10^4$, $4 \times 10^4$, $5 \times 10^4$, $6 \times 10^4$, $7 \times 10^4$, $8 \times 10^4$, $9 \times 10^4$, $1 \times 10^5$, $2 \times 10^5$, $3 \times 10^5$, $4 \times 10^5$, $5 \times 10^5$, or greater, or $6 \times 10^5$, $7 \times 10^5$, $8 \times 10^5$, $9 \times 10^5$, $1 \times 10^6$, $2 \times 10^6$, $3 \times 10^6$, $4 \times 10^6$, $5 \times 10^6 M^{-1}$ $s^{-1}$ or greater.

The variant ADA2 polypeptide provided herein can contain amino acid replacements (i.e. substitutions), additions (i.e. insertions), deletions, truncations or combinations thereof. The variant ADA2 can contain modification(s) in any region or domain of an ADA2 polypeptide provided the resulting variant ADA2, when in active form, for example as a dimer, at least retains adenosine deaminase activity. For purposes herein, reference to modification(s) in an ADA2 polypeptide is with respect to residues of the mature ADA2 polypeptide set forth in SEQ ID NO:5. Amino acid replacements can be made at corresponding residues of any ADA2 polypeptide or catalytically active fragment thereof, including in any ADA2 polypeptide or variant ADA2 polypeptide known in the art. Corresponding residues can be identified by alignment with the mature polypeptide set forth in SEQ ID NO:5 (see e.g. FIG. 1, Table 1). Reference also is made throughout the application and Examples to numbering based on Zavialov (Zavialov et al. (2010) J. Biol. Chem. 285:12367-12377), which is based on the numbering of amino acids residues set forth in SEQ ID NO:4. See Table 1, which sets forth the corresponding position numbers of Zavialov numbering (SEQ ID NO:4) and mature ADA2 numbering (SEQ ID NO:5).

To retain adenosine deaminase activity, modifications typically are not at those positions that are less tolerant to change Such positions can be within domains or regions that are required for catalytic activity, substrate binding and/or dimerization. For example, such positions include regions that are highly conserved, such as residues required for zinc coordination or active site residues. A skilled artisan knows or can readily identify amino acid residues that are required for activity and should not be changed. Also, in some instances if a modification is at these positions, it generally is a conservative amino acid substitution. One of skill in the art understands conservative amino acid substitutions, such as those provided in Table 3, can be used to reduce the likelihood of a modification resulting in a reduction in activity.

Variant ADA2 proteins provided herein can contain a polypeptide subunit that exhibits at least 85%, 86%, 87%, 88%, 89%, 90%, 91%, 92%, 93%, 94%, 95%, 96%, 97%, 98%, 99% or more sequence identity to the polypeptide sequence of the unmodified or reference ADA2 polypeptide, such as those set forth in any of SEQ ID NOS:5, 326-334, 340, 375 or 380-383, or a catalytically active fragment thereof. In particular, variant ADA2 proteins provided herein contain a polypeptide subunit that exhibits at least 85%, 86%, 87%, 88%, 89%, 90%, 91%, 92%, 93%, 94%, 95%, 96%, 97%, 98%, 99% or more sequence identity to the polypeptide sequence set forth in SEQ ID NO:5 or a catalytically active fragment thereof. The variant ADA2 proteins provided herein can contain a polypeptide subunit that can contain at least or about or 1, 2, 3, 4, 5, 6, 7, 8, 9, 10, 11, 12, 12, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more amino acid modification(s) compared to the polypeptide sequence of the unmodified or reference ADA2 polypeptide. It is understood that when present as a dimer or multimer, the variant ADA2 can contain at least or about or 1, 2, 3, 4, 5, 6, 7, 8, 9, 10, 11, 12, 12, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acid modification(s).

For purposes herein, amino acid replacements are denoted by the replaced amino acid, the amino acid position and the replacing amino acid (e.g. K11A by mature numbering, which represents that the amino acid at a position corresponding to amino acid residue 11 in SEQ ID NO:5, e.g. lysine, is replaced by alanine). For purposes herein, amino acid replacements can also be denoted by the replaced amino acid, the amino acid position and the replacing amino acid (e.g. K14A by Zavialov numbering, which represents that the amino acid at a position corresponding to amino acid residue 14 in SEQ ID NO:4, e.g. lysine, is replaced by alanine). See Table 1, which sets forth the corresponding position numbers of Zavialov numbering (SEQ ID NO:4) and mature ADA2 numbering (SEQ ID NO:5). Nomenclature also is employed herein to represent the insertion (--→followed by position of insertion) or deletion (e.g. position of deletion (del) followed by →--) of an amino acid residue at a corresponding position in SEQ ID NO:5, by mature numbering, and/or by SEQ ID NO:4, by Zavialov numbering. For example, --→N1 by mature numbering means that the residue at position 1 is inserted compared to the corresponding sequence of mature ADA2 set forth in SEQ ID NO:5. For example, --→N4 by Zavialov numbering means that the residue at position 4 is inserted compared to the corresponding sequence of ADA2 set forth in SEQ ID NO:4. It is understood that in some cases, due to deletions or insertions of amino acid residues, the numbering of residues in a variant ADA2 polypeptide is altered compared to the numbering of residues set forth in SEQ ID NO:5. In such instances, it is within the level of a skilled artisan to identify residues in the corresponding variant ADA2 polypeptide that correspond to residues in SEQ ID NO:5, for example by alignment as demonstrated in FIG. 1. For example, the numbering of residues in a variant ADA2 polypeptide can be numbered based on Zavialov (Zavialov et al. (2010) J. Biol. Chem. 285:12367-12377), which is based on the numbering of amino acids residues set forth in SEQ ID NO:4. See Table 1, which sets forth the corresponding position numbers of Zavialov numbering (SEQ ID NO:4) and mature ADA2 numbering (SEQ ID NO:5).

Exemplary modifications in a variant ADA2 polypeptide provided herein are described in further detail below. The variant ADA2 provided herein include those that, when in active form, exhibit altered or improved activities or properties compared to the corresponding form of the reference or wildtype ADA2 not containing the modification(s) (i.e. the unmodified ADA2). For example, the variant ADA2 provided herein include those that, when in active form, exhibit altered or improved activities or properties compared to the corresponding form of an unmodified ADA2 containing an ADA2 polypeptide having a sequence of amino acids that exhibits at least 85% sequence identity to SEQ ID NO:5 or a catalytically active fragment thereof, such as those set forth in any of SEQ ID NOS:5, 326-334, 340, 375 or 380-383, or a catalytically active fragment thereof. In particular, the modifications provided herein can affect any one or more activities from among increased adenosine deaminase activity, attenuated heparin binding, increased half-life, altered pH optimum, increased thermal stability, reduced receptor binding, or hyperglycosylation compared to the corresponding form of the ADA2 not containing the modifications (i.e. the unmodified ADA2).

In particular, the active form is the dimer form, such as the homodimer form, that contains the variant ADA2 polypeptide. Thus, in examples herein, variant ADA2 proteins containing a variant ADA2 polypeptide provided herein, when in dimer form, exhibit altered or improved activities or properties compared to the corresponding dimer form of the reference or wildtype ADA2 not containing the modifications. For example, the variant ADA2 provided herein include those that, when in dimer form, exhibit altered or improved activities or properties compared to the corresponding dimer form of an unmodified ADA2 containing an ADA1 polypeptide having a sequence of amino acids that exhibits at least 85% sequence identity to SEQ ID NO:5 or a catalytically active fragment thereof, such as those set forth in any of SEQ ID NOS:5, 326-334, 340, 375 or 380-383, or a catalytically active portion thereof. For example, provided are variant ADA2 containing a variant ADA2 polypeptide provided herein that, when in dimer form, exhibit altered or improved activities or properties compared to the ADA2 homodimer containing the sequence of amino acids set forth in SEQ ID NO:5 or a catalytically active fragment thereof. In particular, the modifications provided herein can affect any one or more activities from among increased adenosine deaminase activity, attenuated heparin binding, increased half-life, altered pH optimum, increased thermal stability, reduced receptor binding, or hyperglycosylation compared to the corresponding form of the ADA2 not containing the modifications (i.e. the unmodified ADA2).

For example, provided herein are variant ADA2 proteins that, when in active form such as dimer form, exhibit increased adenosine deaminase activity. For example, the variant ADA2 protein, when in active form such as dimer form, can exhibit at least 110%, 120%, 130%, 140%, 150%, 160%, 170%, 180%, 190%, 200%, 225%, 250%, 300%, 350%, 400%, 450%, 500%, 600%, 700%, 800%, 900%, 1000% or more activity of the corresponding form of the unmodified ADA2, wherein adenosine deaminase activity is assessed under the same conditions. The catalytic efficiency ($k_{cat}/K_M$) of a variant ADA2 that exhibits increased adenosine deaminase activity is at least or at least about 1.2-fold, 1.3-fold, 1.4-fold, 1.5-fold, 1.6-fold, 1.7-fold, 1.8-fold, 1.9-fold, 2.0-fold, 2.2-fold, 2.5-fold, 3.0-fold, 3.5-fold, 4-fold, 4.5-fold, 5.0-fold, 6.0-fold, 7.0-fold, 8.0-fold, 9.0-fold, 10.0-fold greater or more, or 11.0-fold, 12.0-fold, 13.0-fold, 14.0-fold, 15.0-fold greater or more compared to the catalytic efficiency ($k_{cat}/K_M$) of the corresponding form of the unmodified ADA2, wherein catalytic efficiency of adenosine deaminase activity is assessed under the same conditions. For example, when in dimer form, the variant ADA2 provided herein exhibits a catalytic efficiency ($k_{cat}/K_M$) that is at least $2\times10^4$ $M^{-1}$ $s^{-1}$, $3\times10^4 M^{-1}$ $s^{-1}$, $4\times10^4 M^{-1}$ $s^{-1}$, $5\times10^4 M^{-1}$ $s^{-1}$, $6\times10^4$ $M^{-1}$ $s^{-1}$, $7\times10^4$ $M^{-1}$ $s^{-1}$, $8\times10^4$ $M^{-1}$ $s^{-1}$, $9\times10^4 M^{-1}$ $s^{-1}$, $1\times10^5$ $M^{-1}$ $s^{-1}$, $2\times10^5$ $M^{-1}$ $s^{-1}$, $3\times10^5$ $M^{-1}$ $s^{-1}$, $4\times10^5 M^{-1}$ $s^{-1}$, $5\times10^5$ or greater, or $6\times10^5 M^{-1}$ $s^{-1}$, $7\times10^5 M^{-1}$ $s^{-1}$, $8\times10^5$ $M^{-1}$ $s^{-1}$, $9\times10^5 M^{-1}$ $s^{-1}$, $1\times10^6 M^{-1}$ $s^{-1}$, $2\times10^6 M^{-1}$ $s^{-1}$, $3\times10^6 M^{-1}$ $s^{-1}$, $4\times10^6 M^{-1}$ $s^{-1}$, $5\times10^6 M^{-1} s^{-1}$ or greater.

In examples herein, provided herein are variant ADA2 proteins that, when in active form such as dimer form, exhibit reduced binding to any one or more adenosine receptor (ADR) selected from among $A_1$, $A_{2A}$, $A_{2B}$ and $A_3$, and typically one or both of $A_{2A}$ or $A_{2B}$. Without being bound by theory, it is contemplated herein that the activity of the adenosine deaminase activity provided herein for converting adenosine to inosine is greater or more efficient if binding of the ADA2 to an ADR is reduced. For example, provided herein are variant ADA2, when in active form such as dimer form, in which binding to one or more ADR is reduced at least or at least about 0.5-fold, 1-fold, 1.5-fold, 2-fold, 3-fold, 4-fold, 5-fold, 6-fold, 7-fold, 8-fold, 9-fold, 10-fold or more compared to the corresponding form of the unmodified ADA2.

In examples herein, provided herein are variant ADA2 proteins that, when in active form such as dimer form, exhibit reduced or attenuated heparin binding. ADA2 binds glycosaminoglycans (GAGs), including heparin and its analogs, such as heparan sulfate, and chondroitin sulfate. High-affinity binding to heparin/GAGs is mediated by a large, highly positively charged surface at the interface of dimer, and dimerization of ADA2 forms the heparin binding site. Because glycosaminoglycan is widely present throughout the body, it could interact with the administered ADA2 and act as a peripheral sink. Therefore, an ADA2 with reduced heparin binding can increase the bioavailability and pharmacokinetics of the administered ADA2. For example, ADA2 variants with attenuated heparin binding provided herein, result in improved bioavailability and pharmacokinetics, such as increased half-life, when administered, because the administered ADA2 molecules will not be sequestered in the peripheral sink by binding to the GAGs. In particular, provided herein are variant ADA2 proteins that, when in active form such as dimer form, exhibit no more than 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, or 95% of the heparin binding of the corresponding form of the unmodified ADA2, wherein heparin binding is assessed under the same conditions.

In examples herein, provided are variant ADA2 proteins that, when in active form such as dimer form, exhibit an increased or longer plasma or serum half-life ($t_{1/2}$). For example, variant ADA2 provided herein, when in active form such as dimer form, exhibit a half-life that is at least or at least about 110%, 120%, 130%, 140%, 150%, 160%, 170%, 180%, 190%, 200%, 225%, 250%, 300%, 350%, 400%, 450%, 500%, 600%, 700%, 800% or more longer, or 900%, 1000%, 1100%, 1200%, 1300%, 1400%, 1500%, 1600%, 1700%, 1800%, 1900%, 2000%, 3000%, 4000%, 5000%, 6000%, 7000%, 8000%, 9000%, 10000%, or more longer than the half-life of the corresponding form of the unmodified ADA2, wherein half-life is assessed under the same conditions.

In examples herein, provided are variant ADA2 proteins that, when in active form such as dimer form, exhibit an increased thermal stability. For example, when in active form such as dimer form, variant ADA2 provided herein exhibit thermal stability with a melting temperature (Tm) that is increased at least or at least about 0.5° C., 1.0° C., 2.0° C., 3.0° C., 4.0° C., 5.0° C., 6.0° C., 7.0° C., 8.0° C., 9.0° C., 10.0° C. or more compared to the Tm of the corresponding form of the unmodified ADA2, wherein Tm is assessed under the same conditions. The melting temperature (Tm) of variant ADA2, when in active form such as dimer form, provided herein can be at least or at least about 67.6° C., 67.8° C., 68.0° C., 68.2° C., 68.4° C., 68.6° C., 68.8° C., 69.0° C., 69.2° C., 69.4° C., 69.6° C., 69.8° C., 70.0° C., 70.2° C., 70.4° C., 70.6° C., 70.8° C., 71.0° C., 71.2° C., 71.4° C., 71.6° C., 71.8° C. or higher.

In examples herein, the adenosine deaminase activity of ADA2 or variants can be exhibited at a pH optima of from or from about pH 6.0 to pH 7.6, such as a pH of at least pH 6, 6.25, 6.5, 6.75, 7, 7.25 or 7.5. For example, ADA2 has a pH optima of at or about pH 6.5±0.2. Variant ADA2 proteins provided herein can exhibit a pH optima for adenosine deaminase activity of from or from about pH 6.0 to 6.8, such as at or about pH 6.5±0.2. In some cases, the variant ADA2 exhibits an altered pH optimum and the catalytic activity can be exhibited at a higher pH that is from or from about pH 6.8 to pH 7.6, such as from or from about pH 7.0 to pH 7.5 or pH 7.2 to pH 7.4, each inclusive. Since proliferating tissue near blood vessels in the TME can have a more neutral pH, such variants could be more active in particular tumor environments. For example, ADA2 variant can exhibit a pH optima for adenosine deaminase activity of at least pH 6.8, 6.9, 7.0, 7.1, 7.2, 7.3, 7.4, 7.5, 7.6 or higher. Based on this description, it is within the level of one of skill in the art to generate a variant ADA2 containing any one or more of the described modification(s), and test each for adenosine deaminase activity and/or one or more of properties from among heparin binding, half-life, pH optimum, thermal stability, receptor binding and/or glycosylation as described herein.

a. EXEMPLARY MODIFICATIONS i. Amino Acid Replacements

In one example, the modification(s) can be an amino acid replacement(s). Provided herein are variant ADA2 polypeptides that contain one or more amino acid replacements in an ADA2 polypeptide at an amino acid position corresponding to amino acid residue 11, 13, 20, 22, 26, 86, 109, 118, 119, 124, 133, 139, 179, 183, 191, 217, 219, 221, 224, 258, 262, 264, 266, 267, 277, 283, 296, 309, 317, 321, 352, 366, 371, 372, 373, 374, 403, 404, 405, 406, 441, 444, 452, 461, 469 or 470, by mature numbering, with reference to amino acid residues set forth in SEQ ID NO:5. For example, the amino replacement can be at an amino acid position corresponding to amino acid residue K11, K13, R20, V22, K26, D86, F109, R118, F119, P124, W133, Y139, E179, F183, Y191, R217, R219, L221, Y224, K258, S262, H264, S266, K267, R277, R283, V296, K309, K317, K321, R352, R366, K371, K372, D373, I374, T403, G404, H405, P406, R441, K444, K452, K461, K469 or K470, by mature numbering, with reference to amino acid residues set forth in SEQ ID NO:5.

For example, provided herein are variant ADA2 polypeptides that contain one or more amino acid replacements in an ADA2 polypeptide that is any one or more of: K11A, K11D, K11E, K13A, K13D, K13E, R20A, R20D, R20E, R20N, V22S, K26A, K26D, K26E, D86A, D86C, D86E, D86F, D86G, D86H, D86I, D86K, D86L, D86M, D86N, D86P, D86Q, D86R, D86S, D86T, D86V, D86W, D86Y, F109S, F109A, R118D, R118A, F119S, F119K, P124A, P124S, W133S, W133T, Y139T, Y139A, E179A, E179C, E179D, E179F, E179G, E179H, E179I, E179K, E179L, E179M, E179N, E179P, E179Q, E179R, E179S, E179T, E179V, E179W, E179Y, F183K, Y191S, Y191D, R217A, R217D, R217E, R219A, R219C, R219D, R219E, R219F, R219G, R219H, R219I, R219K, R219L, R219M, R219N, R219P, R219Q, R219S, R219T, R219V, R219W, R219Y, L221A, L221C, L221D, L221E, L221F, L221 G, L221H, L221I, L221K, L221M, L221N, L221P, L221Q, L221R, L221S, L221T, L221V, L221W, L221Y, Y224R, Y224N, K258A, K258D, K258E, S262A, S262C, S262D, S262E, S262F, S262G, S262H, S262I, S262K, S262L, S262M, S262N, S262P, S262Q, S262R, S262T, S262V, S262W, S262Y, H264A, H264C, H264D, H264E, H264F, H264G, H264I, H264K, H264L, H264M, H264N, H264P, H264Q, H264R, H264S, H264T, H264V, H264W, H264Y, S266A, S266C, S266D, S266E, S266F, S266G, S266H, S266I, S266K, S266L, S266M, S266N, S266P, S266Q, S266R, S266T, S266V, S266W, S266Y, K267A, K267C, K267D, K267E, K267F, K267G; K267H, K267I, K267L, K267M, K267N, K267P, K267Q, K267R, K267S, K267T, K267V, K267W, K267Y, R277A, R277D, R277E, R283A, R283D, R283E, V296A, V296C, V296D, V296E, V296F, V296G, V296H, V296I, V296K, V296L, V296M, V296N, V296P, V296Q, V296R, V296S, V296T, V296W, V296Y, K309A, K309D, K309E, K317A, K317D, K317E, K321A, K321D, K321E, R352A, R352D, R352E, R366A, R366D, R366E, K371A, K371D, K371E, K371N, K372A, K372D, K372E, K372N, D373S, I374S, T403N, G404N, H405S, P406S, R441A, R441D, R441E, K444A, K444D, K444E, K452A, K452D, K452E, K461A, K461D, K461E, K469A, K469D, K469E, K470A, K470D, and K470E, by mature numbering, with reference to amino acid residues set forth in SEQ ID NO:5.

In particular, provided herein are variant ADA2 polypeptides that contain one or more amino acid replacements in an ADA2 polypeptide that is any one or more of: K11A, K11E, R20A, R20D, R20E, R219K, R219Q, L221A, L221V, L221G, S262N, H264Q, H264G R366A, R366D, R366E, K371A, K371D, K371E, K372A, K372D, K372E and K452E, by mature numbering, with reference to amino acid residues set forth in SEQ ID NO:5. For example, provided herein are variant ADA2 polypeptides that contain one or more amino acid replacements in an ADA2 polypeptide that is any one or more of: K11A, K11E, R20A, R20E, R219K, R219Q, L221A, L221V, L221G, S262N, H264Q, H264G, R366A, K371A, K371D, K371E, K372D, K372E, K452D and K452E, by mature numbering, with reference to amino acid residues set forth in SEQ ID NO:5. In another example, provided herein are variant ADA2 polypeptides that contain one or more amino acid replacements in an ADA2 polypeptide that is any one or more of R20A, R20D, R20E, S262N, R366A, R366D, R366E, K371A, K371D, K371E, K372A, K372D, K372E and K452E, by mature numbering, with reference to amino acid residues set forth in SEQ ID NO:5. In examples, provided herein are variant ADA2 polypeptides that contain one or more amino acid replacements in an ADA2 polypeptide that is any one or more of K11A, R20A, R20E, R219Q, S262N, K371A, K371D or K371E, by mature numbering, with reference to amino acid residues set forth in SEQ ID NO:5.

Also provided herein are variant ADA2 polypeptides that contain 2, 3, 4, 5, 6, 7, 8, 9, 10, 11, 12, 13, 14, 15, 16, 17, 18, 19 or 20 amino acid replacements compared to the reference ADA2 polypeptide not containing the modifications (i.e. the unmodified ADA2). Variant ADA2 polypeptides can contain any two or more amino acid replacements provided above, so long as the resulting ADA2 variant exhibits or retains adenosine deaminase activity. The two or more amino acid replacements can confer the same altered activity or a different altered activity. For example, one amino acid replacement can confer altered heparin binding and the other can confer increased adenosine deaminase activity. Hence, the resulting ADA2 polypeptide variants exhibit two or more altered activities or properties.

For example, provided herein are variant ADA2 polypeptides that contain amino acid replacements K11A/R20A; K11A/R20A/K371A; R20A/K371A; K11A/K371A; S262N/K371D; S262N/K371E; S262N/R20E; S262N/R20E/K371D; S262N/R20E/K371E; R219Q/K371E; R219Q/K371D; R219Q/R20E; R219Q/K371E/R20E; R219Q/K371D/R20E; R219Q/S262N/K371E; R219Q/S262N/K371D; R219Q/S262N/R20E; R219Q/S262N/K371E/R20E; R219Q/S262N/K371D/R20E; or R219Q/S262N, by mature numbering, with reference to amino acid residues set forth in SEQ ID NO:5.

For example, provided herein are variant ADA2 polypeptides that contain amino acid replacements K11A/R20A; K11A/R20A/K371A; R20A/K371A; K11A/K371A; S262N/K371D; S262N/K371E; S262N/R20E; S262N/R20E/K371D; S262N/R20E/K371E; R219Q/K371E; R219Q/K371D; R219Q/R20E; R219Q/K371E/R20E; R219Q/K371D/R20E; R219Q/S262N/K371E; R219Q/S262N/K371D; R219Q/S262N/R20E; R219Q/S262N/K371E/R20E; R219Q/S262N/K371D/R20E; or R219Q/S262N, by mature numbering, with reference to amino acid residues set forth in SEQ ID NO:5.

Exemplary of such variant ADA2 polypeptides are any set forth in any of SEQ ID NOS:13-63 or 71-273, or a catalytically active portion thereof.

In other examples, also provided herein are variant ADA2 polypeptides that contain amino acid replacements R219Q/S262N/K11A; R219Q/S262N/K11D; R219Q/S262N/K11E; R219Q/S262N/K13A; R219Q/S262N/K13D; R219Q/S262N/K13E; R219Q/S262N/K371A; R219Q/S262N/K372A; R219Q/S262N/K372D; R219Q/S262N/K372E; R219Q/S262N/K452A; R219Q/S262N/K452D; R219Q/S262N/K452E; R219Q/S262N/R20A; R219Q/S262N/R20D; R219Q/S262N/R366A; R219Q/S262N/R366D; R219Q/S262N/R366E; R219Q/S262N/H264A; R219Q/S262N/H264Q; R219Q/S262N/H264N; R219Q/S262N/H264G; R219K/S262N; R219N/S262N; R219A/S262N; R219Q/S262N/L221A; R219Q/S262N/L221V; R219Q/S262N/L221G; R219Q/S262N/E179D; R219Q/S262N/E179A; R219Q/S262N/E179S; R219Q/S262N/E179T; R219Q/S262N/E179V; R219Q/S262N/E179G; R219Q/S262A; R219Q/S262V; R219Q/S262M; R219Q/S262N/

K11A/R20A; R219Q/S262N/K11A/R20A/K371A; R219Q/ S262N/R20A/K371A; R219Q/S262N/K11A/K371A; R219Q/S262N/K26A; R219Q/S262N/K26D; R219Q/ S262N/K26E; R219Q/S262N/R217A; R219Q/S262N/ R217D; R219Q/S262N/R217E; R219Q/S262N/K258A; R219Q/S262N/K258D; R219Q/S262N/K258E; R219Q/ S262N/R277A; R219Q/S262N/R277D; R219Q/S262N/ R277E; R219Q/S262N/R283A; R219Q/S262N/R283D; R219Q/S262N/R283E; R219Q/S262N/K309A; R219Q/ S262N/K309D; R219Q/S262N/K309E; R219Q/S262N/ K317A; R219Q/S262N/K317D; R219Q/S262N/K317E; R219Q/S262N/K321A; R219Q/S262N/K321D; R219Q/ S262N/K321E; R219Q/S262N/R352A; R219Q/S262N/ R352D; R219Q/S262N/R352E; R219Q/S262N/R441A; R219Q/S262N/R441D; R219Q/S262N/R441E; R219Q/ S262N/K444A; R219Q/S262N/K444D; R219Q/S262N/ K444E; R219Q/S262N/K461A; R219Q/S262N/K461D; R219Q/S262N/K461E; R219Q/S262N/K469A; R219Q/ S262N/K469D; R219Q/S262N/K469E; R219Q/S262N/ K470A; R219Q/S262N/K470D; R219Q/S262N/K470E; R219Q/S262N/D86A; R219Q/S262N/D86C; R219Q/ S262N/D86E; R219Q/S262N/D86F; R219Q/S262N/D86G; R219Q/S262N/D86H; R219Q/S262N/D86I; R219Q/ S262N/D86K; R219Q/S262N/D86L; R219Q/S262N/ D86M; R219Q/S262N/D86N; R219Q/S262N/D86P; R219Q/S262N/D86Q; R219Q/S262N/D86R; R219Q/ S262N/D86S; R219Q/S262N/D86T; R219Q/S262N/D86V; R219Q/S262N/D86W; R219Q/S262N/D86Y; R219Q/ S262N/E179C; R219Q/S262N/E179F; R219Q/S262N/ E179H; R219Q/S262N/E179I; R219Q/S262N/E179K; R219Q/S262N/E179L; R219Q/S262N/E179M; R219Q/ S262N/E179N; R219Q/S262N/E179P; R219Q/S262N/ E179Q; R219Q/S262N/E179R; R219Q/S262N/E179W; R219Q/S262N/E179Y; R219C/S262N; R219D/S262N; R219E/S262N; R219F/S262N; R219G/S262N; R219H/ S262N; R219I/S262N; R219L/S262N; R219M/S262N; R219P/S262N; R219S/S262N; R219T/S262N; R219V/ S262N; R219W/S262N; R219Y/S262N; R219Q/S262N/ L221C; R219Q/S262N/L221D; R219Q/S262N/L221E; R219Q/S262N/L221F; R219Q/S262N/L221H; R219Q/ S262N/L221I; R219Q/S262N/L221K; R219Q/S262N/ L221M; R219Q/S262N/L221N; R219Q/S262N/L221P; R219Q/S262N/L221Q; R219Q/S262N/L221R; R219Q/ S262N/L221S; R219Q/S262N/L221T; R219Q/S262N/ L221W; R219Q/S262N/L221Y; R219Q/S262C; R219Q/ S262D; R219Q/S262E; R219Q/S262F; R219Q/S262G; R219Q/S262H; R219Q/S262I; R219Q/S262K; R219Q/ S262L; R219Q/S262P; R219Q/S262Q; R219Q/S262R; R219Q/S262T; R219Q/S262W; R219Q/S262Y; R219Q/ S262N/H264C; R219Q/S262N/H264D; R219Q/S262N/ H264E; R219Q/S262N/H264F; R219Q/S262N/H264I; R219Q/S262N/H264K; R219Q/S262N/H264L; R219Q/ S262N/H264M; R219Q/S262N/H264P; R219Q/S262N/ H264R; R219Q/S262N/H264S; R219Q/S262N/H264T; R219Q/S262N/H264V; R219Q/S262N/H264W; R219Q/ S262N/H264Y; R219Q/S262N/S266A; R219Q/S262N/ S266C; R219Q/S262N/S266D; R219Q/S262N/S266E; R219Q/S262N/S266F; R219Q/S262N/S266G; R219Q/ S262N/S266H; R219Q/S262N/S266I; R219Q/S262N/ S266K; R219Q/S262N/S266L; R219Q/S262N/S266M; R219Q/S262N/S266N; R219Q/S262N/S266P; R219Q/ S262N/S266Q; R219Q/S262N/S266R; R219Q/S262N/ S266T; R219Q/S262N/S266V; R219Q/S262N/S266W; R219Q/S262N/S266Y; R219Q/S262N/K267A; R219Q/ S262N/K267C; R219Q/S262N/K267D; R219Q/S262N/ K267E; R219Q/S262N/K267F; R219Q/S262N/K267G; R219Q/S262N/K267H; R219Q/S262N/K267I; R219Q/ S262N/K267L; R219Q/S262N/K267M; R219Q/S262N/ K267N; R219Q/S262N/K267P; R219Q/S262N/K267Q; R219Q/S262N/K267R; R219Q/S262N/K267S; R219Q/ S262N/K267T; R219Q/S262N/K267V; R219Q/S262N/ K267W; R219Q/S262N/K267Y; R219Q/S262N/V296A; R219Q/S262N/V296C; R219Q/S262N/V296D; R219Q/ S262N/V296E; R219Q/S262N/V296F; R219Q/S262N/ V296G; R219Q/S262N/V296H; R219Q/S262N/V296I; R219Q/S262N/V296K; R219Q/S262N/V296L; R219Q/ S262N/V296M; R219Q/S262N/V296N; R219Q/S262N/ V296P; R219Q/S262N/V296Q; R219Q/S262N/V296R; R219Q/S262N/V296S; R219Q/S262N/V296T; R219Q/ S262N/V296W; R219Q/S262N/V296Y; R219Q/K11A/ R20A; R219Q/K11A/R20A/K371A; R219Q/R20A/K371A; R219Q/K11A/K371A; S262N/K11A/R20A; S262N/K11A/ R20A/K371A; S262N/R20A/K371A; or S262N/K11A/ K371A, by mature numbering, with reference to amino acid residues set forth in SEQ ID NO:5.

Exemplary of such variant ADA2 polypeptides are any set forth in any of SEQ ID NOS:659-663 or 682-917, or a catalytically active portion thereof.

ii. Modification(s) of PRB Domain

In other examples, also provided herein are modified ADA2 polypeptides that contain a modified PRB domain. The PRB domain is not required for catalytic activity, and, hence, as shown herein, can be removed so that the ADA2 variant proteins activities other than deaminase activity, mediated by ADA2, are reduced or eliminated. According to the reported domain organization of ADA2, the PRB domain corresponds to residues 98-156 or 105-148 of mature ADA2 set forth in SEQ ID NO:5. The modifications of the PRB domain can include deletion of all or a portion of the PRB domain (i.e. deletion of one or more residues of the PRB domain), insertion of one or more amino acid residues into the PRB domain, amino acid replacement of one or more residues of the PRB domain or a combination thereof to thereby reduce or inhibit binding of the domain to a receptor or other activity thereof. For example, the PRB domain can contain up to or about or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, or 59 modified positions, such as generally up to or about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43 or 44 modified positions.

In one example, as described in more detail below, all or a portion of the PRB domain can be deleted, such as by deletion of one or more contiguous amino acid residues of the PRB domain. For example, provided herein are variant ADA2 in which one or more contiguous amino acid residues between or about between amino acid residues 98 and 156 or amino acid residues 105 and 148 or amino acid residues 105 and 147 or amino acid residues 99 and 144, inclusive, with reference to residues set forth in SEQ ID NO:5, are deleted. Exemplary of such ADA2 polypeptides are deletion of contiguous amino acid residues corresponding to contiguous residues 98-156, 105-148, 105-147, 102-147 or 108-150, by mature numbering, with reference to the sequence of amino acids set forth in SEQ ID NO:5. For example, exemplary of such ADA2 polypeptides include polypeptides ADA2_del98-156 (98-156del; SEQ ID NO:548); ADA2_del105-148 (105-148del; SEQ ID NO:549); ADA2_del105-147 (105-147del; SEQ ID NO:550); and ADA2_del99-144 (99-144del; SEQ ID NO:579), by mature numbering, with reference to the sequence of amino acids set forth in SEQ ID NO:5.

In some examples, the variant ADA2 that contains a modification in the PRB domain, such as a deletion of contiguous residues, also contains a substitution of the modified or deleted region with a peptide linker. As a result, all or a portion of the PRB domain can be replaced with a sterically acceptable peptide linker sequence. In such examples, at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or all more contiguous amino acids from the PRB domain can be substituted or replaced with amino acids of a peptide linker that generally does not exceed 60 amino acids, and generally does not exceed 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, or 50 amino acids. Any suitable linker can be selected so long as the resulting variant ADA2 exhibits adenosine deaminase activity.

Examples of peptide linkers include, but are not limited to: (Gly)n, where n is 2 to 20 (SEQ ID NO:368); -Gly-Gly-; GGG (SEQ ID NO:369); GGGG (SEQ ID NO:362); GGGGG (SEQ ID NO:360); GGGGGGG (SEQ ID NO:370); GGGGGGGGGG (SEQ ID NO:371); GGGGGGGGGGGGGGG (SEQ ID NO:372); GGGGS or (GGGGS)n (SEQ ID NO:343); GGGGSGGGGS (SEQ ID NO:580); GGGGSGGGGSGGGGS (SEQ ID NO:367); SSSSG or (SSSSG)n (SEQ ID NO:344); GKSSGSGSESKS (SEQ ID NO:345); GGSTSGSGKSSEGKG (SEQ ID NO:346); GSTSGSGKSSSEGSGSTKG (SEQ ID NO:347); GSTSGSGKPGSGEGSTKG (SEQ ID NO:348); EGKSSGSGSESKEF (SEQ ID NO:349); or AlaAlaProAla or (AlaAlaProAla)n (SEQ ID NO:350), where n is 1 to 6, such as 1, 2, 3, or 4. In particular examples, the peptide linker is GGG (SEQ ID NO:369); GGGGG (SEQ ID NO:360); GGGGGGG (SEQ ID NO:370); GGGGGGGGGG (SEQ ID NO:371); GGGGGGGGGGGGGGG (SEQ ID NO:372); GGGGS (SEQ ID NO:343); GGGGSGGGGS (SEQ ID NO:580); or GGGGSGGGGSGGGGS (SEQ ID NO:367).

Exemplary of such a modification is a variant ADA2 designated C105-T147del→(Gly)$_n$ (SEQ ID NO:280), where n is 2 to 20, whereby the PRB domain in the region corresponding to residues 105-147 with reference to numbering in SEQ ID NO:5 is replaced with a glycine linker of 2 to 20 amino acid residues in length. For example, the variant ADA2 can be C105-T147del→(Gly)$_{15}$ (SEQ ID NO:281), C105-T147del→(Gly)$_{10}$ (SEQ ID NO:282), C105-T147del→(Gly)$_7$ (SEQ ID NO:283); C105-T147del→(Gly)$_5$ (SEQ ID NO:284) or C105-T147del→(Gly)$_3$ (SEQ ID NO:285). Further examples of such a modification is a variant ADA designated V99-Q144del→(GGGGS)$_n$ (SEQ ID NO:581), where n is 1 to 5, whereby the PRB domain in the region corresponding to residues 99-144 with reference to numbering in SEQ ID NO:5 is replaced with a (GGGGS)$_n$ linker where the sequence of amino acids in the linker is repeated 1 to 5 times such that the linker is 5, 10, 15, 20 or 25 amino acid residues in length. For example, the variant ADA2 can be V99-Q144del→(GGGGS)$_1$ (SEQ ID NO:583); V99-Q144del→(GGGGS)$_2$ (SEQ ID NO:584); or V99-Q144del→(GGGGS)$_3$ (SEQ ID NO:585). Further examples of such a modification is a variant ADA designated C105-T147del→(GGGGS)$_n$ (SEQ ID NO:582), where n is 1 to 5, whereby the PRB domain in the region corresponding to residues 105-147 with reference to numbering in SEQ ID NO:5 is replaced with a (GGGGS)$_n$ linker where the sequence of amino acids in the linker is repeated 1 to 5 times such that the linker is 5, 10, 15, 20 or 25 amino acid residues in length. For example, the variant ADA2 can be C105-T147del→(GGGGS)$_1$ (SEQ ID NO:586); C105-T147del→(GGGGS)$_2$ (SEQ ID NO:587); or C105-T147del→(GGGGS)$_3$ (SEQ ID NO:588), by mature numbering, with reference to the sequence of amino acids set forth in SEQ ID NO:5. Exemplary of such variant ADA2 polypeptides are any set forth in any of SEQ ID NOS:281-285 and 583-588, or a catalytically active portion thereof.

Also provided herein are variant ADA2 polypeptides that contain deletions, insertions, substitutions and/or amino acid replacements in the PRB domain, combined with other deletions, insertions, substitutions and/or amino acid replacements provided herein. For example, provided are variant ADA2 polypeptides that contain a deletion of all or a portion of the PRB domain, such as by deletion of one or more contiguous amino acid residues of the PRB domain, combined with 1, 2, 3, 4, 5, 6, 7, 8, 9, 10, 11, 12, 13, 14, 15, 16, 17, 18, 19 or 20 additional amino acid replacements compared to the unmodified reference ADA2. Also provided herein are variant ADA2 polypeptides that contain a modification in the PRB domain, such as a deletion of contiguous residues and also contains a substitution of the modified or deleted region with a peptide linker, combined with 1, 2, 3, 4, 5, 6, 7, 8, 9, 10, 11, 12, 13, 14, 15, 16, 17, 18, 19 or 20 additional amino acid replacements compared to the unmodified reference ADA2. For example, the variant ADA2 polypeptides that contain both a deletion of all or portion of the PRB domain and any one or more amino acid replacements provided above, so long as the resulting ADA2 variant exhibits or retains adenosine deaminase activity. The deletion and/or amino acid replacements can confer the same altered activity or a different altered activity. For example, deletion and/or substitution of the PRB domain can confer one altered activity, e.g., reduction in binding to a receptor, and amino acid replacement(s) can confer increased adenosine deaminase activity. Hence, the resulting ADA2 polypeptide variants exhibit two or more altered activities or properties.

For example, provided herein are variant ADA2 polypeptides that contain the following combination of deletions and/or substitutions and/or amino acid replacements: K371D/V99-Q144del→(GGGGS)$_1$; K371D/V99-Q144del→(GGGGS)$_2$; K371D/V99-Q144del→(GGGGS)$_3$; K371D/C105-T147del→(GGGGS)$_1$; K371D/C105-T147del→(GGGGS)$_2$; K371D/C105-T147del→(GGGGS)$_3$; R219Q/S262N/C105-T147del→(Gly)$_{15}$; R219Q/S262N/C105-T147del→(Gly)$_{10}$; R219Q/S262N/C105-T147del→(Gly)$_7$; R219Q/S262N/C105-T147del→(Gly)$_5$; R219Q/S262N/C105-T147del→(Gly)$_3$; R219Q/S262N/V99-Q144del→(GGGGS)$_1$; R219Q/S262N/V99-Q144del→(GGGGS)$_2$; R219Q/S262N/V99-Q144del→(GGGGS)$_3$; R219Q/S262N/C105-T147del→(GGGGS)$_1$; R219Q/S262N/C105-T147del→(GGGGS)$_2$; R219Q/S262N/C105-T147del→(GGGGS)$_3$; R219Q/S262N/K371D/V99-Q144del→(GGGGS)$_1$; R219Q/S262N/K371D/V99-Q144del→(GGGGS)$_2$; R219Q/S262N/K371D/V99-Q144del→(GGGGS)$_3$; R219Q/S262N/K371D/C105-T147del→(GGGGS)$_1$; R219Q/S262N/K371D/C105-T147del→(GGGGS)$_2$; R219Q/S262N/K371D/C105-T147del→(GGGGS)$_3$; K371D/C105-T147del→(Gly)n (where n is 2 to 20); K371D/C105-T147del→(Gly)$_{15}$; K371D/C105-T147del→(Gly)$_{10}$; K371D/C105-T147del→(Gly)$_7$; K371D/C105-T147del→(Gly)$_5$; K371D/C105-T147del→(Gly)$_3$; K371D/V99-

Q144del→(GGGGS)n (where n is 1 to 5); K371D/C105-T147del→(GGGGS)n (where n is 1 to 5); K371D/N98-N156del; K371D/C105-E148del; K371D/C105-T147del; K371D/V99-Q144del; R219Q/S262N/C105-T147del→(Gly)n (where n is 2 to 20); R219Q/S262N/V99-Q144del→(GGGGS)n (where n is 1 to 5); R219Q/S262N/C105-T147del→(GGGGS)n (where n is 1 to 5); R219Q/S262N/N98-N156del; R219Q/S262N/C105-E148del; R219Q/S262N/C105-T147del; R219Q/S262N/V99-Q144del; R219Q/S262N/K371D/C105-T147del→(Gly)n (where n is 2 to 20); R219Q/S262N/K371D/C105-T147del→$(Gly)_{15}$; R219Q/S262N/K371D/C105-T147del→$(Gly)_{10}$; R219Q/S262N/K371D/C105-T147del→$(Gly)_7$; R219Q/S262N/K371D/C105-T147del→$(Gly)_5$; R219Q/S262N/K371D/C105-T147del→$(Gly)_3$; R219Q/S262N/K371D/V99-Q144del→(GGGGS)n (where n is 1 to 5); R219Q/S262N/K371D/C105-T147del→(GGGGS)n (where n is 1 to 5); R219Q/S262N/K371D/N98-N156del; R219Q/S262N/K371D/C105-E148del; R219Q/S262N/K371D/C105-T147del; R219Q/S262N/K371D/V99-Q144del; R219Q/C105-T147del→(Gly)n (where n is 2 to 20); R219Q/V99-Q144del→(GGGGS)n (where n is 1 to 5); R219Q/C105-T147del→(GGGGS)n (where n is 1 to 5); R219Q/N98-N156del; R219Q/C105-E148del; R219Q/C105-T147del; R219Q/V99-Q144del; S262N/C105-T147del→(Gly)n (where n is 2 to 20); S262N/V99-Q144del→(GGGGS)n (where n is 1 to 5); S262N/C105-T147del→(GGGGS)n (where n is 1 to 5); S262N/N98-N156del; S262N/C105-E148del; S262N/C105-T147del; and S262N/V99-Q144del, by mature numbering, with reference to amino acid residues set forth in SEQ ID NO:5.

Exemplary of such variant ADA2 polypeptides are any set forth in any of SEQ ID NOS:589-594, 602-606, 634-658, 664-681, 918-931, or a catalytically active portion thereof.

iii. Amino Acid Replacement(s) with Altered Interaction Between the PRB Domain and Other Regions of ADA2

In yet other examples, also provided herein are modified ADA2 polypeptides that contain amino acid replacements that confer altered interaction between the PRB domain and the rest of ADA2 (e.g., the adenosine deaminase (ADA) domain). For example, according to the reported domain organization of ADA2, the PRB domain corresponds to residues 98-156 or 105-148 of mature ADA2 set forth in SEQ ID NO:5. Provided herein are variant ADA2 polypeptides that contain one or more amino acid replacements in an ADA2 polypeptide at an amino acid position corresponding to amino acid residue 109, 118, 119, 124, 133, 139, 183, 191 or 224, by mature numbering, with reference to amino acid residues set forth in SEQ ID NO:5. For example, the amino replacement can be at an amino acid position corresponding to amino acid residue F109, R118, F119, P124, W133, Y139, F183, Y191 or Y224 with reference to amino acid residues set forth in SEQ ID NO:5. Modifications at each position, or combination thereof, can alter the interaction between the PRB domain and other domains in ADA2, such as the ADA domain.

For example, provided herein are variant ADA2 polypeptides that contain one or more amino acid replacements in an ADA2 polypeptide that is any one or more of: F109S, F109A, R118D, R118A, F119S, F119K, P124A, P124S, W133S, W133T, Y139T, Y139A, F183K, Y191S, Y191D, Y224R or Y224N, by mature numbering, with reference to amino acid residues set forth in SEQ ID NO:5.

Also provided herein are variant ADA2 polypeptides that contain amino acid replacements that confer altered interaction between the PRB domain and the rest of ADA2, combined with other deletions, insertions, substitutions and/or amino acid replacements provided herein. For example, provided are variant ADA2 polypeptides that contain 2, 3, 4, 5, 6, 7, 8, 9, 10, 11, 12, 13, 14, 15, 16, 17, 18, 19 or 20 amino acid replacements compared to the reference ADA2 polypeptide not containing the modifications (i.e. the unmodified ADA2). Variant ADA2 polypeptides can contain any two or more amino acid replacements provided above, so long as the resulting ADA2 variant exhibits or retains adenosine deaminase activity. The two or more amino acid replacements can confer the same altered activity or a different altered activity. For example, one amino acid replacement can confer altered interaction between the PRB domain the ADA domain, and the other can confer increased adenosine deaminase activity. Hence, the resulting ADA2 polypeptide variants exhibit two or more altered activities or properties.

For example, provided herein are variant ADA2 polypeptides that contain amino acid replacements Y191D/Y224R; R219Q/S262N/F119S; R219Q/S262N/F119K; R219Q/S262N/Y224R; R219Q/S262N/Y224N; R219Q/S262N/Y191S; R219Q/S262N/Y191D; R219Q/S262N/F183K; R219Q/S262N/Y191D/Y224R; R219Q/S262N/F109S; R219Q/S262N/F109A; R219Q/S262N/R118D; R219Q/S262N/R118A; R219Q/S262N/Y139T; R219Q/S262N/Y139A; R219Q/S262N/W133S; R219Q/S262N/W133T; R219Q/S262N/P124A; or R219Q/S262N/P124S, by mature numbering, with reference to amino acid residues set forth in SEQ ID NO:5.

Exemplary of such variant ADA2 polypeptides are any set forth in any of SEQ ID NOS:561-578 or 616-633, or a catalytically active portion thereof.

iv. Hyperglycosylation

Included among the variant ADA2 provided herein are those that have been modified by altering the level and/or type of glycosylation compared to an unmodified ADA2. Glycosylation can be increased or decreased compared to the unmodified ADA2 polypeptide. In some instances, the level or extent of glycosylation is increased, resulting in a hyperglycosylated ADA2 polypeptide or protein. This can be achieved, for example, by incorporation of at least one non-native glycosylation site not found in the unmodified ADA2 polypeptide or protein to which a carbohydrate is linked. Hyperglycosylated ADA2 polypeptides also can be generated by linkage of a carbohydrate moiety to at least one native glycosylation site found but not glycosylated in the unmodified ADA2 polypeptide.

The variant ADA2 proteins provided herein can contain altered, such as new, 0-linked glycosylation, N-linked glycosylation or O-linked and N-linked glycosylation. In some examples, a variant ADA2 includes 1, 2, 3, 4, 5 or more carbohydrate moieties, each linked to different glycosylation sites. The glycosylation site(s) can be a native glycosylation site(s) and/or a non-native glycosylation site(s). In some examples, the variant ADA2 is glycosylated at more than one non-native glycosylation site. For example, a variant ADA2 can be modified to introduce 1, 2, 3, 4, 5, 6, 7, 8, 9, 10 or more non-native glycosylation sites.

Non-native glycosylation sites can be introduced by amino acid replacement. O-glycosylation sites can be created, for example, by amino acid replacement of a native residue with a serine or threonine. N-linked glycosylation sites can be created by creating the motif Asn-Xaa-Ser/Thr/

Cys, where Xaa is not proline. Creation of this consensus sequence by amino acid modification can involve replacement of a native amino acid residue with an asparagine, replacement of a native amino acid residue with a serine, threonine or cysteine, or replacement of a native amino acid residue with an asparagine and amino acid replacement of native residue with a serine, threonine or cysteine. Non-native glycosylation sites can be created in any region in an ADA2 polypeptide. The level of glycosylation (e.g. the number of introduced non-native glycosylation sites) can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the level of glycosylation of the corresponding form of the unmodified or wild-type ADA2.

Exemplary modifications provided herein include introducing a non-native glycosylation site by modification with one or more amino acid replacement(s) that include, but are not limited to, replacement with: N at a position corresponding to position 20 and S at a position corresponding to position 22; N at a position corresponding to position 371 and S at a position corresponding to position 373; N at a position corresponding to position 372 and S at a position corresponding to position 374; N at a position corresponding to position 403 and S at a position corresponding to position 405; and N at a position corresponding to position 404 and S at a position corresponding to position 406, each by mature numbering, with reference to positions set forth in SEQ ID NO:5. For example, amino acid replacement(s) to introduce a non-native glycosylation site can include: R20N/V22S; K371N/D373S; K372N/I374S; T403N/H405S; or G404N/P406S, by mature numbering, with reference to amino acid residues set forth in SEQ ID NO:5.

In other examples, modifications provided herein include introducing a non-native glycosylation site by modification with one or more amino acid replacement(s) in or near the PRB domain. Exemplary modifications provided herein include introducing a non-native glycosylation site by modification with one or more amino acid replacement(s) that include, but are not limited to, replacement with:

N at a position corresponding to position 125 and A at a position corresponding to position 126; N at a position corresponding to position 127 and S at a position corresponding to position 129; N at a position corresponding to position 126 and T at a position corresponding to position 128; N at a position corresponding to position 112 and T at a position corresponding to position 114; N at a position corresponding to position 134, C at a position corresponding to position 135 and T at a position corresponding to position 136; N at a position corresponding to position 134, S at a position corresponding to position 135 and T at a position corresponding to position 136; N at a position corresponding to position 142 and S at a position corresponding to position 144; N at a position corresponding to position 137 and T at a position corresponding to position 139; N at a position corresponding to position 111 and S at a position corresponding to position 113, each by mature numbering, with reference to positions set forth in SEQ ID NO:5. For example, amino acid replacement(s) to introduce a non-native glycosylation site in or near the PRB domain can include: R125N/P126A; S127N/K129S; P126N/E128T; R112N/I114T; I134N/L135C/L136T; I134N/L135S/L136T; R142N/Q144S; E137N/Y139T; or P111N/G113S, by mature numbering, with reference to amino acid residues set forth in SEQ ID NO:5.

In other examples, also provided herein are modified ADA2 polypeptides that contain addition (i.e. insertion) of one or more contiguous residues at the N-terminus or the C-terminus. Such replacements can introduce a non-native glycosylation site. The modified ADA2 polypeptides can contain insertion of up to or about or 1, 2, 3, 4, 5, 6, 7, 8, 9, 10, 11, 12, 13, 14, 15, 16, 17, 18, 19, 20 or more amino acid residues at one or both of the N-terminus or C-terminus. For example, addition or insertion of amino acids can provide for altered glycosylation sites in the encoded protein. Exemplary of a modification is insertion --→N--→A2/--→S3 at the N-terminus, by mature numbering, with reference to the amino acid positions set forth in SEQ ID NO:5.

Exemplary of such variant ADA2 polypeptides are any set forth in any of SEQ ID NOS:274-279 and 552-560.

Also provided herein are variant ADA2 polypeptides that contain one or more amino acid replacement(s) that introduce a non-native glycosylation site, combined with other deletions, insertions, substitutions and/or amino acid replacements provided herein. For example, provided are variant ADA2 polypeptides that contain 2, 3, 4, 5, 6, 7, 8, 9, 10, 11, 12, 13, 14, 15, 16, 17, 18, 19 or 20 amino acid replacements compared to the reference ADA2 polypeptide not containing the modifications (i.e. the unmodified ADA2). Variant ADA2 polypeptides can contain any two or more amino acid replacements provided above, so long as the resulting ADA2 variant exhibits or retains adenosine deaminase activity. The two or more amino acid replacements can confer the same altered activity or a different altered activity. For example, one or more amino acid replacement(s) can introduce a non-native glycosylation site, and another amino acid replacement(s) can confer increased adenosine deaminase activity. Hence, the resulting ADA2 polypeptide variants exhibit two or more altered activities or properties.

For example, provided herein are variant ADA2 polypeptides that contain amino acid replacements R219Q/S262N/--→N1/--→A2/--→S3; R219Q/S262N/R20N/V22S; R219Q/S262N/K371N/D373S; R219Q/S262N/K372N/I374S; R219Q/S262N/T403N/H405S; R219Q/S262N/G404N/P406S; R219Q/S262N/R125N/P126A; R219Q/S262N/S127N/K129S; R219Q/S262N/P126N/E128T; R219Q/S262N/R112N/I114T; R219Q/S262N/I134N/L135C/L136T; R219Q/S262N/I134N/L135S/L136T; R219Q/S262N/R142N/Q144S; R219Q/S262N/E137N/Y139T; or R219Q/S262N/P111N/G113S, by mature numbering, with reference to amino acid residues set forth in SEQ ID NO:5.

Exemplary of such variant ADA2 polypeptides are any set forth in any of SEQ ID NOS:596-601 or 607-615, or a catalytically active portion thereof.

b. NUCLEIC ACID MOLECULES

Also provided herein are nucleic acid molecules that encode any of the variant ADA2 polypeptides provided herein. A modified nucleic acid molecule that encodes any of the variant ADA2 polypeptides provided herein includes codon changes corresponding to modifications provided herein (e.g. replacement or substitution, insertion or addition, or deletion of one or more nucleotides). It is within the level of a skilled artisan, who is familiar with codons that correspond to various amino acids, to identify such codon changes based on exemplification of the modified amino acids herein. In particular examples, the nucleic acid sequence can be codon optimized, for example, to increase expression levels of the encoded sequence. The particular codon usage is dependent on the host organism in which the modified polypeptide is expressed. One of skill in the art is familiar with optimal codons for expression in mammalian or human cells, bacteria or yeast, including for example *Escherichia coli* or *Saccharomyces cerevisiae*. For example, codon usage information is available from the Codon Usage Database available at kazusa. or .jp.codon (see e.g. Richmond (2000) *Genome Biology*, 1:241 for a description of the database). See also, Forsburg (2004) *Yeast*, 10:1045-1047; Brown et al. (1991) *Nucleic Acids Research*, 19:4298; Sharp et al. (1988) *Nucleic Acids Res.*, 12:8207-8211; Sharp et al. (1991) *Yeast*, 657-78). Vectors contain the nucleic acid molecules for expression and production of the ADA2 polypeptides are provided.

c. PRODUCTION OF VARIANT ADA2 PROTEINS

The variant ADA2 polypeptides and encoding nucleic acid molecules provided herein can be produced by standard recombinant DNA techniques known to one of skill in the art. Any method known in the art to effect mutation of any one or more amino acids in a target protein can be employed. Methods include standard site-directed or random mutagenesis of encoding nucleic acid molecules, or solid phase polypeptide synthesis methods. In particular, total chemical synthesis methods, including peptide synthesis followed by peptide ligation can be employed. Nucleic acid molecules encoding an ADA2 polypeptide can be subjected to mutagenesis, such as random mutagenesis of the encoding nucleic acid, error-prone PCR, site-directed mutagenesis (using e.g., a kit, such as kit such as QuikChange available from Stratagene), overlap PCR, gene shuffling, or other recombinant methods. The nucleic acid encoding the polypeptides can then be introduced into a host cell to be expressed heterologously. In some examples, the variant ADA2 polypeptides are produced synthetically, such as using total chemical synthesis, solid phase or solutions phase peptide synthesis.

Exemplary methods for producing and expressing a nucleic acid molecule encoding an ADA2 polypeptide, including any variant ADA2 polypeptide, are described in Section E. Depending on how the variant ADA2 molecule is produced, or the particular nature of the modification(s), the variant ADA2 polypeptides provided herein can be produced as a monomer, dimer, or other multimer. For example, the variant ADA2 is a heterodimer or homodimer.

In particular, ADA2 normally exists as a homodimer that is composed of two identical polypeptide chains. As described above, nonpolar interactions between residues of two identical polypeptide subunits mediate formation of the homodimer upon secretion of ADA2 from cells. Since wildtype ADA2 is a homodimer, it is understood that mention of an amino acid sequence of the reference or unmodified ADA2 polypeptide refers to the sequence of amino acids of a single ADA2 polypeptide subunit. The variant ADA2 can contain one or more ADA2 polypeptide subunits, that are the same (i.e. homodimer) or different (i.e. heterodimer). For example, a variant ADA2 homodimer is readily produced and secreted by cells transformed with a nucleic acid molecule encoding a variant ADA2 polypeptide, such as nucleic acid encoding a polypeptide that has the sequence of amino acids set forth in any of SEQ ID NOS:13-63, 71-285 or 552-931, or a catalytically active fragment thereof. If cells are encoded with two or more different nucleic acid molecules, each encoding a different ADA2 polypeptide, a heterodimer can be produced.

In one example, the variant ADA2 polypeptide provided herein is a dimer. For example, the resulting variant ADA2 polypeptide is a homodimer that contains a first and second polypeptide subunit that are the same, i.e. each has the same amino acid sequence containing the identical modification(s) with respect to the amino acid sequence of the reference or unmodified ADA2 polypeptide. The homodimer can be formed by transforming a nucleic acid molecule encoding the variant polypeptide into a cell, which, upon secretion, results in nonpolar interaction between residues of two variant polypeptide subunits to mediate formation of the dimer.

In another example, the resulting ADA2 polypeptide is a heterodimer that contains a first and second polypeptide subunit that are different. In such an example, one or both of the first or second polypeptide subunit contains a sequence of amino acids containing a modification(s) with respect to the amino acid sequence of the reference or unmodified ADA2 polypeptide. In some cases, both the first and second polypeptide subunit can contain a sequence of amino acids containing a modification(s) compared to the reference of unmodified ADA2 polypeptide, but the nature of the modification(s) are different. The heterodimer can be formed by transforming into a cell both a first nucleic acid molecule encoding a first variant polypeptide subunit and a second nucleic acid molecule encoding a second different polypeptide subunit. The second nucleic acid molecule can encode a polypeptide subunit containing the sequence of amino acids of the reference or wildtype ADA2, or can encode a variant polypeptide subunit containing a sequence of amino acids containing modification(s) with respect to the amino acid sequence of the reference or unmodified ADA2. The heterodimer is produced upon expression and secretion from a cell as a result of nonpolar interaction between residues of the two polypeptide subunits to mediate formation of the dimer. In such processes, generally a mixture of dimeric molecules is formed, including homodimers and heterodimers. For the generation of heterodimers, additional steps for purification can be necessary. For example, the first and second polypeptide can be engineered to include a tag with metal chelates or other epitope, where the tags are different. The tagged domains can be used for rapid purification by metal-chelate chromatography, and/or by antibodies, to allow for detection by western blots, immunoprecipitation, or activity depletion/blocking in bioassays.

In other examples, the variant ADA2 polypeptide is a monomer. A monomer can be produced by mutation of one or more residues that are involved in protein dimerization, so long as the adenosine deaminase activity is retained. Exemplary of residues that can be targeted for mutagenesis include, but are not limited to, amino acid residues 1, 4, 5, 8, 9, 11, 12, 15, 344, 362 or 366, with reference to amino acid residues set forth in SEQ ID NO:5. The residues can be replaced with one of the other nineteen amino acid residues at the position. It is within the level of a skilled artisan to generate and assess monomer formation of a polypeptide. For example, monomer formation can be assessed, and monomers purified, by size-exclusion chromatography (SEC). Adenosine deaminase activity also can be assessed, such as using any of the assays described herein or known in the art.

In some examples, dimeric or other multimeric molecules of a variant ADA2 can be formed by conjugation or fusion of the encoded variant ADA2 polypeptide to any moiety or other polypeptide that are themselves able to interact to form a stable structure. For example, separate encoded ADA2 polypeptides, where at least one is a variant ADA2 polypeptide, can be joined by multimerization, whereby multimerization of the polypeptides is mediated by a multimerization domain. The variant ADA2 dimers or multimers can be formed by generation of a chimeric molecule where a variant ADA2 is linked, directly or indirectly, to a multimerization domain. A nucleic acid molecule encoding a variant ADA2 can be joined (directly or indirectly) with a nucleic acid encoding a multimerization domain. For example, a variant ADA2 dimer provided herein can contain a first ADA2 polypeptide subunit linked directly or indirectly via a linker to a multimerization domain and a second ADA2 polypeptide subunit linked directly or indirectly via a linker to a multimerization domain, wherein one or both of the first and second polypeptide are a variant ADA2 polypeptide. The first and second ADA2 polypeptide can be the same or different. Exemplary of a multimerization domain is an Fc domain, which is described further below.

Homo- or heteromultimeric polypeptides can be generated from co-expression of separate nucleic acid molecules encoding ADA2 polypeptides. Chimeric ADA2 polypeptides can be readily produced and secreted by cells, such as mammalian cells, transformed with the appropriate nucleic acid molecule. For example, a cell can be transformed with a first nucleic acid molecule encoding a variant ADA2 and a second nucleic acid molecule encoding the same or different ADA2. The second nucleic acid molecule can encode a polypeptide subunit containing the sequence of amino acids of the reference or wildtype ADA2, or can encode a variant polypeptide subunit containing a sequence of amino acids containing modification(s) with respect to the amino acid sequence of the reference or unmodified ADA2. The secreted forms of the ADA2 polypeptide include those where the variant ADA2 is a homodimer of the first encoded variant ADA2 polypeptide, a homodimer of the second encoded ADA2 polypeptide, such as wildtype or second variant ADA2 polypeptide, and ADA2 heterodimers containing two polypeptide subunits that are different. In some cases, higher ordered multimers can form.

Multimerization domains are well known to a skilled artisan. Generally, a multimerization domain includes any capable of forming a stable protein-protein interaction. The multimerization domains can interact via an immunoglobulin sequence (e.g. Fc domain; see e.g., International Patent Pub. Nos. WO 93/10151 and WO 2005/063816; U.S. Pub. No. 2006/0024298; U.S. Pat. No. 5,457,035), leucine zipper (e.g. from nuclear transforming proteins fos and jun or the proto-oncogene c-myc or from General Control of Nitrogen (GCN4)), a hydrophobic region, a hydrophilic region, or a free thiol which forms an intermolecular disulfide bond between the chimeric molecules of a homo- or heteromultimer. In addition, a multimerization domain can include an amino acid sequence containing a protuberance complementary to an amino acid sequence comprising a hole, such as is described, for example, in U.S. Pat. No. 5,731,168; International Patent Pub. Nos. WO 98/50431 and WO 2005/063816; Ridgway et al. (1996) Protein Engineering, 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine).

An ADA2 polypeptide, such as any variant ADA2 polypeptide provided herein, can be joined anywhere, but typically via its N- or C-terminus, to the N- or C-terminus of a multimerization domain to form a chimeric polypeptide. The linkage can be direct or indirect via a linker. Also, the chimeric polypeptide can be a fusion protein or can be formed by chemical linkage, such as through covalent or non-covalent interactions. For example, when preparing a chimeric polypeptide containing a multimerization domain, nucleic acid encoding an ADA2 polypeptide can be operably linked to nucleic acid encoding the multimerization domain sequence, directly or indirectly or optionally via a linker domain. The construct can encode a chimeric protein where the C-terminus of the ADA2 polypeptide is joined to the N-terminus of the multimerization domain. In some instances, a construct can encode a chimeric protein where the N-terminus of the ADA2 polypeptide is joined to the N- or C-terminus of the multimerization domain.

In examples where the multimerization domain is a polypeptide, a gene fusion encoding the ADA2-multimerization domain chimeric polypeptide is inserted into an appropriate expression vector. The resulting ADA2-multimerization domain chimeric proteins can be expressed in host cells transformed with the recombinant expression vector, and allowed to assemble into multimers, where the multimerization domains interact to form multivalent polypeptides. Chemical linkage of multimerization domains to ADA2 polypeptides can also be effected using heterobifunctional linkers.

The resulting chimeric polypeptides, and multimers formed therefrom, can be purified by any suitable method such as, for example, by affinity chromatography over Protein A or Protein G columns. Where two nucleic acid molecules encoding different ADA2 chimeric polypeptides are transformed into cells, formation of homo- and heterodimers will occur. Conditions for expression can be adjusted so that heterodimer formation is favored over homodimer formation. For example, for multimers formed by interaction of disulfide-linkage of an Fc multimerization domain, homodimers can be reduced under conditions that favor the disruption of inter-chain disulfides, but do not affect intra-chain disulfides. Alternatively, the formation of this type of heterodimer can be biased by genetically engineering and expressing ADA2 fusion molecules using a multimerization domain that promotes formation of heterodimers, such as using a c-jun and c-fos leucine zipper combination. Since the leucine zippers form predominantly heterodimers, they can be used to drive the formation of the heterodimers when desired. The ADA2 polypeptides contain an Fc region or other multimerization domain also can be engineered to include a tag to permit purification of desired heterodimers. The products of the nuclear oncogenes fos and jun contain leucine zipper domains that preferentially form a heterodimer (O'Shea et al. (1989) Science, 245:646; Turner and Tijian (1989) Science, 243:1689). For example, the leucine zipper domains of the human transcription factors c-jun and c-fos have been shown to form stable heterodimers with a 1:1 stoichiometry (see e.g., Busch and Sassone-Corsi (1990) Trends Genetics, 6:36-40; Gentz et al. (1989) Science, 243:1695-1699). Although jun-jun homodimers also have been shown to form, they are about 1000-fold less stable than jun-fos heterodimers.

D. ADA2 CONJUGATES AND FUSION PROTEINS

Any ADA2 molecule, including any provided herein, can be conjugated, directly or indirectly, to one or more heterologous moiety. The ADA2 can be a wildtype ADA2, including allelic and species variants, or can be any variant described herein in Section C.2. above. The ADA2 molecule in the conjugate can be a monomer or a dimer, for example, a heterodimer or a homodimer. Typically, the ADA2 in the conjugate is a homodimer. The heterologous moiety can be conjugated to one or both polypeptide subunits of the dimer.

For example, the ADA2 can be any that contains a polypeptide having the sequence of amino acids set forth in any of SEQ ID NOS:5 or 326-336, 338-342, 375 or 380-383, or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS:5 or 326-336, 338-342, 375 or 380-383, or a catalytically active fragment thereof. In one example, the ADA2 in the conjugate provided herein can contain a polypeptide having the sequence of amino acids set forth in any of SEQ ID NOS:5 or 326-336, 338-342, 375 or 380-383 or a catalytically active fragment thereof, such as any of SEQ ID NOS:5, 326-334, 340, 375 or 380-383, or a catalytically active fragment thereof. For example, the ADA2 in the conjugate provided herein can contain a polypeptide having the sequence of amino acids set forth in SEQ ID NO:5, or a catalytically active portion thereof. The catalytically active portion can be one that lacks all or a portion of the PRB domain, such as those set forth in any of SEQ ID NOS:548-550 or 579.

In other examples of conjugates provided herein, the conjugate contains a variant ADA2 polypeptide, such as any described herein. For example, conjugates provided herein can be an ADA2 that contains the variant polypeptide set forth in any of SEQ ID NOS:13-63, 71-285 or 552-931.

The heterologous moiety can include protein or polypeptide moieties or non-polypeptide moieties. For example, the heterologous moiety can be, but is not limited to, a peptide, small molecule, nucleic acid, carbohydrate and polymer. The heterologous moiety can be linked, directly or indirectly, to the ADA2 protein molecule. For example, the heterologous moiety can be a protein or polypeptide moiety, which can be directly or indirectly conjugated to the ADA2 polypeptide, or produced as fusion proteins that are directly or indirectly fused. In other cases, the heterologous moiety is a non-peptide moiety that is conjugated to the ADA2 molecules.

The ADA2 protein can be conjugated to one or more heterologous moieties, such as 1, 2, 3, 4, 5, 6, 7, 8, 9, 10 or more heterologous moieties. A heterologous moiety can be a heterologous polypeptide moiety, or a heterologous non-polypeptide moiety, or both. In other examples, the heterologous moieties can include a combination of a heterologous polypeptide and a non-polypeptide moiety. In some examples, all the heterologous moieties are identical. In some examples, at least one heterologous moiety is different from the other heterologous moieties. In some examples, any ADA2 provided herein can be conjugated to two, three or more than three heterologous moieties in tandem. In other examples, any ADA2 provided herein can be conjugated to two, three, or more heterologous moieties wherein at least an additional moiety is interposed between two heterologous moieties (e.g., an ADA2 polypeptide, a linker, a protease-cleavable substrate, a self-immolative spacer, or combinations thereof).

Conjugation with heterologous moieties can confer beneficial properties compared to an ADA2 molecule that is not conjugated with the heterologous moiety. Exemplary heterologous moieties are moieties that increase the in vivo half-life of the molecule. Other exemplary beneficial properties provided by a heterologous moiety include, but are not limited to, increased protein expression in mammalian expression systems, improved biophysical properties such as stability and solubility, improved protein purification and detection, visualization and localization and/or increased enzymatic activity. For example, a heterologous moiety can be one that facilitates detection, visualization or localization of an ADA2 protein molecule or a fragment thereof containing the heterologous moiety. Detection, visualization and/or location of any ADA2 fragment thereof can be in vivo, in vitro, ex vivo, or combinations thereof.

In some cases, when conjugated to an ADA2 or fragment thereof, the heterologous moiety increases stability of the ADA2 or a fragment thereof. For example, the presence of the heterologous moiety can maintain one or more physical properties of an ADA2 in response to an environmental condition (e.g., an elevated temperature or low or high pH conditions) compared to the physical property in the absence of the heterologous moiety. In some examples, the physical property can include maintenance of the covalent structure of an ADA2 (e.g., the absence of proteolytic cleavage, unwanted oxidation or deamidation). In other examples, the physical property can be the maintenance of a properly folded state (e.g., the absence of soluble or insoluble aggregates or precipitates). The stability of any ADA2 or ADA2 conjugate can be measured by assaying a biophysical property of the protein, for example thermal stability, pH unfolding profile, stable removal of glycosylation, solubility, biochemical function (e.g. adenosine deaminase activity or heparin binding activity) and/or combinations thereof. Stability can be measured using methods known in the art, such as, HPLC (high performance liquid chromatography), SEC (size exclusion chromatography), DLS (dynamic light scattering). Methods to measure thermal stability include, but are not limited to differential scanning calorimetry (DSC), differential scanning fluorimetry (DSF), circular dichroism (CD), and thermal challenge assay. Exemplary methods to assess the stability of any ADA2 or conjugate are described below in Section F.

In some examples, when conjugated to an ADA2 or fragment thereof, the presence of the heterologous moiety reduces or attenuates binding of ADA2 to heparin and other glycosaminoglycans (GAGs) compared to the ADA2 protein not containing the heterologous moiety (i.e. the free or non-conjugated ADA2). For example, ADA2 conjugates provided herein include those that exhibit no more than 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, or 95% of the heparin binding of the ADA2 protein not containing the heterologous moiety (i.e. the free or non-conjugated ADA2). For example, it is shown herein that PEGylated ADA2 exhibits reduced heparin binding compared to the corresponding non-PEGylated ADA2 (see e.g. Example 8). Typically, the heparin binding is exhibited when the ADA2 is in dimer form, and the ADA2 conjugate is a dimer. It also is understood the comparison of binding between the conjugated and non-conjugated form is assessed under the same or substantially the same conditions. In particular, the reduction in binding in the presence of the heterologous moiety in the conjugate can be due to steric blockage and/or alteration of electrostatic charges on the surface.

In examples of conjugates provided herein, the heterologous moiety improves one or more properties of the ADA2 (e.g. half-life) without substantially affecting the biological activity or function of the ADA2 protein (e.g., adenosine deaminase activity). For example, ADA2 conjugates provided herein exhibit about 50% to 500%, such as about 50% to 400%, 50% to 300%, 50% to 200%, 50% to 150%, 50% to 100%, 50% to 80%, 80% to 400%, 80% to 300%, 80% to 200%, 80% to 150%, 80% to 100%, 100% to 400%, 100% to 300%, 100% to 200% or 100% to 150% of the adenosine deaminase activity compared to the ADA2 protein not containing the heterologous moiety (i.e. the free or non-conjugated ADA2). For example, the ADA2 conjugate can exhibit at least 50%, 60%, 70%, 75%, 80%, 85%, 90%, 95%, 100%, 110%, 120%, 130%, 140%, 150%, 160%, 170%, 180%, 190%, 200%, 210%, 220%, 230%, 240%, 250%, 260%, 270%, 280%, 290%, 300%, 350%, 400%, 450%, 500% or more of the adenosine deaminase activity compared to the ADA2 polypeptide not containing the heterologous moiety (i.e. the free or non-conjugated ADA2). In some cases, ADA2 conjugates provided herein exhibit increased or improved adenosine deaminase activity compared to the ADA2 polypeptide not containing the heterologous moiety (i.e. the free or non-conjugated ADA2), such as greater than 100% or more adenosine deaminase activity. Typically, the adenosine deaminase activity is exhibited when the ADA2 is in dimer form, and the ADA2 conjugate is a dimer. It also is understood the comparison of adenosine binding between the conjugated and non-conjugated form is assessed under the same or substantially the same conditions.

1. Half-Life Extending Moieties

Non-limiting examples of heterologous moieties include any that, when conjugated or linked (directly or indirectly) to the ADA2 molecule, confers an increase in the in vivo and/or in vitro half-life compared to the free- or non-conjugated ADA2. Half-life of any ADA2 provided herein can be determined by any method known to those of skill in the art and/or described herein, e.g., adenosine deaminase activity assays. Exemplary of such half-life extending moieties are described in the following subsections.

For example, the heterologous moieties are peptides and polypeptides with either unstructured or structured characteristics that are associated with the prolongation of in vivo half-life when conjugated to an ADA2. Non-limiting examples include albumin, albumin fragments, Fc fragments of immunoglobulins, the β subunit of the C-terminal peptide (CTP) of the β subunit of human chorionic gonadotropin, HAP sequences, XTEN sequences, a transferrin or a fragment thereof, a PAS polypeptide, polyglycine linkers, polyserine linkers, albumin-binding moieties, non-natural amino acid based conjugation or half-life extension, or any fragments, derivatives, variants, or combinations of these polypeptides.

The heterologous moiety can be a half-life extending moiety, i.e., a heterologous moiety that increases the in vivo half-life of any ADA2 provided herein compared to the in vivo half-life of the ADA2 lacking such heterologous moiety. In vivo half-life of any ADA2 provided herein can be determined by any method known to those of skill in the art and/or described herein, e.g., adenosine deaminase activity assays.

Exemplary half-life extending moieties that can be conjugated, directly or indirectly, to any ADA2 provided herein include: biocompatible fatty acids and derivatives thereof, hydroxy alkyl starch (HAS) (e.g. hydroxy ethyl starch (HES)), polyethylene glycol (PEG), Poly $(Gly_x\text{-}Ser_y)_n$, homo-amino-acid polymers (HAP), hyaluronic acid (HA), heparosan polymers (HEP), phosphorylcholine-based polymers (PC polymer), Fleximers, dextran, polysialic acids (PSA), Fc domain, Transferrin, Albumin, elastin-like peptides, XTEN sequences, albumin binding peptides, a CTP peptide, a non-natural amino acid or non-natural amino acid conjugate, and any combination thereof.

In some example, when conjugated to an ADA2 or fragment thereof, the presence of one or more half-life extending moieties results in the half-life of any ADA2 provided herein to be increased compared to the half-life of the ADA2 lacking such one or more half-life extending moieties (i.e. the free or non-conjugated ADA2). For example, ADA2 conjugates provided herein exhibit a half-life that is at least about 110%, 120%, 130%, 140%, 150%, 160%, 170%, 180%, 190%, 200%, 225%, 250%, 300%, 350%, 400%, 450%, 500%, 600%, 700%, 800% or more longer than the half-life of ADA2 polypeptide not containing the heterologous moiety (i.e. the free or non-conjugated ADA2), or 900%, 1000%, 1100%, 1200%, 1300%, 1400%, 1500%, 1600%, 1700%, 1800%, 1900%, 2000%, 3000%, 4000%, 5000%, 6000%, 7000%, 8000%, 9000%, 10000%, or more longer than the half-life of ADA2 polypeptide not containing the heterologous moiety (i.e. the free or non-conjugated ADA2). In some examples, the half-life of any ADA2 conjugate provided herein that is linked, directly or indirectly, to a half-life extending moiety exhibits a half-life that is about 1.5-fold to about 20-fold, about 1.5-fold to about 15-fold, about 1.5-fold to about 10-fold longer, about 2-fold to about 10-fold, about 2-fold to about 9-fold, about 2-fold to about 8-fold, about 2-fold to about 7-fold, about 2-fold to about 6-fold, about 2-fold to about 5-fold, about 2-fold to about 4-fold, about 2-fold to about 3-fold, about 2.5-fold to about 10-fold, about 2.5-fold to about 9-fold, about 2.5-fold to about 8-fold, about 2.5-fold to about 7-fold, about 2.5-fold to about 6-fold, about 2.5-fold to about 5-fold, about 2.5-fold to about 4-fold, about 2.5-fold to about 3-fold, about 3-fold to about 10-fold, about 3-fold to about 9-fold, about 3-fold to about 8-fold, about 3-fold to about 7-fold, about 3-fold to about 6-fold, about 3-fold to about 5-fold, about 3-fold to about 4-fold, about 4-fold to about 6 fold, about 5-fold to about 7-fold, or about 6-fold to about 8-fold longer than the half-life of the corresponding ADA2 lacking such half-life extending moiety. Typically, the half-life for activity in vivo is exhibited when the ADA2 is in dimer form, and the ADA2 conjugate is a dimer. It also is understood the comparison of half-life between the conjugated and non-conjugated form is assessed under the same or substantially the same conditions.

In some examples, the half-life of any ADA2 conjugate provided herein that is linked, directly or indirectly, to a half-life extending moiety can be or is at least or at least about 10 hours, 11 hours, 12 hours, 13 hours, 14 hours, 15 hours, 16 hours, 17 hours, 18 hours, 19 hours, 20 hours, 21 hours, 22 hours, 23 hours, 24 hours, 25 hours, 26 hours, 27 hours, 28 hours, 29 hours, 30 hours, 32 hours, 34 hours, 36 hours, 38 hours, 40 hours, 42 hours, 46 hours, 48 hours, 50 hours, 55 hours, 60 hours, 65 hours, 70 hours, 75 hours, 80 hours or more. For example, the half-life of any ADA2 conjugate provided herein can be 10 hours to 60 hours, such as 12 hours to 48 hours or 13 hours to 36 hours. For example, Example 9 shows that an ADA2 conjugate that is a PEGylated ADA2 exhibits a half-life of about or approximately 12 to 14 hours, and PEGylated variant ADA2 molecules (e.g. R20E or K371D) exhibit an even greater half-life of about or approximately 16 hours to 24 hours. Example 14 shows that other PEGylated variant ADA2 molecules (e.g. R219Q/S262N) exhibit an even greater half-life of about or approximately 39 hours to 47 hours.

The following sub-sections describe exemplary half-life extending moieties in the ADA2 conjugates provided herein.

a. Low Complexity Polypeptides

An ADA2 conjugate provided herein can include an ADA2 that is linked, directly or indirectly, to at least one heterologous moiety that is a polypeptide with low compositional and/or structural complexity (e.g., a disordered polypeptide with no secondary or tertiary structure in solution under physiologic conditions). In one example, the low complexity polypeptide sequences are made of unstructured, hydrophilic amino acid polymers. The low complexity polypeptides can provide beneficial properties, for example, if the protein is subjected to higher temperature or harsh conditions, such as HPLC purification.

b. C-Terminal Peptide (CTP) of the β Subunit of Human Chorionic Gonadotropin

An ADA2 conjugate provided herein can include an ADA2 that is linked, directly or indirectly, to a heterologous moiety that includes one C-terminal peptide (CTP) of the β subunit of human chorionic gonadotropin, or fragment, variant, or derivative thereof. One or more CTP peptides inserted into a recombinant protein is known to increase the in vivo half-life of that protein (see, e.g., U.S. Pat. No. 5,712,122). Exemplary CTP peptides include DPRFQDSSSSKAPPPSLPSPSRLPGPSDTPIL (SEQ ID NO:303) or SSSSKAPPPSLPSPSRLPGPSDTPILPQ. (SEQ ID NO:304) (See, e.g., U.S. Patent Publication No. US 2009/0087411).

c. Immunoglobulin Constant Region (Fc) or Portions Thereof

An ADA2 conjugate provided herein can include an ADA2 that is linked, directly or indirectly, to an Fc domain or variant thereof. Fc domains, fragments, variants, and derivatives are known to one of skill in the art and are described, e.g., in U.S. Pat. No. 5,457,035; U.S. Patent Publication No. US 2006/0024298, International PCT Publication Nos. WO 2011/069164, WO 2012/006623, WO 2012/006635, or WO 2012/006633, each of which is incorporated by reference herein in its entirety. Preparations of fusion proteins containing polypeptides fused to various portions of antibody-derived polypeptides (including the Fc domain) has been described, see e.g., Ashkenazi et al. (1991) *PNAS* 88: 10535; Byrn et al. (1990) *Nature,* 344:667; and Hollenbaugh and Aruffo, (2002) "Construction of Immunoglobulin Fusion Proteins," in *Current Protocols in Immunology*, Ch. 10, pp. 10.19.1-10.19.11.

An Fc region has domains denoted $C_H$ (constant heavy) domains ($C_H1$, $C_H2$, $C_H3$ (optionally $C_H4$)). Depending on the isotype, (i.e. IgG, IgM, IgA IgD or IgE), the Fc region can have three or four CH domains. Some isotypes (e.g. IgG) Fc regions also contain a hinge region (see Janeway et al. 2001, Immunobiology, Garland Publishing, N.Y., N.Y.). In humans, there are five antibody isotypes classified based on their heavy chains denoted as delta (δ), gamma (γ), mu (μ), and alpha (α) and epsilon (ε), giving rise to the IgD, IgG, IgM, IgA, and IgE classes of antibodies, respectively. The IgA and IgG classes contain the subclasses IgA1, IgA2, IgG1, IgG2, IgG3, and IgG4. Sequence differences between immunoglobulin heavy chains cause the various isotypes to differ in, for example, the number of C domains, the presence of a hinge region, and the number and location of interchain disulfide bonds. For example, IgM and IgE heavy chains contain an extra C domain ($C_H4$), that replaces the hinge region. The Fc regions of IgG IgD, and IgA pair with each other through their Cγ3, Cδ3, and Cα3 domains, whereas the Fc regions of IgM and IgE dimerize through their Cμ4 and Cε4 domains. IgM and IgA form multimeric structures with ten and four antigen-binding sites, respectively.

Fc regions are known to a skilled artisan, and any can be used in the conjugates provided herein so long as the resulting conjugate retains adenosine deaminase activity. An Fc region or a portion thereof for producing any ADA2 provided herein can be obtained from a number of different sources. In some examples, an Fc region or a portion thereof is derived from a human immunoglobulin. The Fc region or a portion thereof can also be derived from an immunoglobulin of another mammalian species, including for example, a rodent (e.g. a mouse, rat, rabbit, guinea pig) or non-human primate (e.g. chimpanzee, macaque) species. Moreover, the Fc region or a portion thereof can be derived from any immunoglobulin class, including IgG (including human subclasses IgG1, IgG2, IgG3, or IgG4), IgA (including human subclasses IgA1 and IgA2), IgD, IgE, and IgM. In one example, the human isotype IgG1 is used. An ADA2 provided herein that is conjugated to an Fc region of an immunoglobulin can confer several desirable properties including increased stability, increased serum half-life (see Capon et al. (1989) Nature 337:525) as well as binding to Fc receptors such as the neonatal Fc receptor (FcRn) (U.S. Pat. Nos. 6,086,875, 6,485,726, 6,030,613; WO 03/077834; US 2003/0235536, each of which is incorporated by reference herein in its entirety). In other examples, where effector functions mediated by the Fc-Fc receptor (FcR) interactions are to be minimized, fusion with IgG isotypes that poorly recruit complement or effector cells, such as for example, the Fc of IgG2 or IgG4, is contemplated. Further, linkers can be used to covalently link Fc to another polypeptide to generate a Fc chimera.

Exemplary sequences of heavy chain constant regions for human IgG sub-types are set forth in SEQ ID NO:355 (IgG1), SEQ ID NO:356 (IgG2), SEQ ID NO:357 (IgG3), and SEQ ID NO:358 (IgG4). For example, for the exemplary heavy chain constant region set forth in SEQ ID NO:355, the $C_H1$ domain corresponds to amino acids 1-98, the hinge region corresponds to amino acids 99-110, the $C_H2$ domain corresponds to amino acids 111-223, and the $C_H3$ domain corresponds to amino acids 224-330.

Modified Fc domains also are contemplated herein for conjugation to any ADA2 provided herein. In some examples, the Fc region is modified such that it exhibits altered binding to an FcR to result in altered (i.e. more or less) effector function compared to the effector function of an Fc region of a wild-type immunoglobulin heavy chain Thus, a modified Fc domain can have altered affinity, including but not limited to, increased or low or no affinity for the Fc receptor. For example, the different IgG subclasses have different affinities for the Fcγ receptors (FcγRs), with IgG1 and IgG3 typically binding substantially better to the receptors than IgG2 and IgG4. In addition, different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. In some instances, an ADA2 conjugate including an Fc domain provided herein can be modified to enhance binding to the complement protein C1q.

In certain examples, Fc region for conjugation to any ADA2 provided herein can include one or more truncated Fc regions that are nonetheless sufficient to confer Fc receptor (FcR) binding properties to the Fc region. For example, the portion of an Fc region that binds to FcRn (i.e., the FcRn binding portion) can include from about amino acids 282-438 of IgG1, with the primary contact sites being amino acids 248, 250-257, 272, 285, 288, 290-291, 308-311, and 314 of the $C_H2$ domain and amino acid residues 385-387, 428, and 433-436 of the $C_H3$ domain (amino acid numbering based on the EU numbering system; see Edelman et al. (1969) PNAS 63:78-85 and Kabat et al. (1991) *Sequences of Proteins of Immunological Interest*, Fifth Edition, U.S. Department of Health and Human Services, NIH Publication No. 91-3242). Thus, an Fc region in any ADA2 provided herein can include an FcRn binding portion. FcRn binding portions can be derived from heavy chains of any isotype, including IgG1, IgG2, IgG3 and IgG4. Altering the affinity of an Fc region for a receptor can modulate the effector functions and/or pharmacokinetic properties associated by the Fc domain. Modified Fc domains are known to one of skill in the art and described in the literature, see e.g. U.S. Pat. No. 5,457,035; U.S. Patent Publication No. US 2006/0024298; and International Patent Publication No. WO 2005/063816 for exemplary modifications.

In certain examples, an Fc region for conjugation to any ADA2 provided herein can include at least one of: a hinge (e.g., upper, middle, and/or lower hinge region) domain (about amino acids 216-230 of an antibody Fc region based on EU numbering), a $C_H2$ domain (about amino acids 231-340 of an antibody Fc region based on EU numbering), a $C_H3$ domain (about amino acids 341-438 of an antibody Fc region based on EU numbering), a $C_H4$ domain, or a variant, portion, or fragment thereof. In other examples, an Fc region can include a complete Fc domain (i.e., a hinge domain, a $C_H2$ domain, and a $C_H3$ domain). In some examples, an Fc region can include, a hinge domain (or a portion thereof) fused to a $C_H3$ domain (or a portion thereof), a hinge domain (or a portion thereof) fused to a $C_H2$ domain (or a portion thereof), a $C_H2$ domain (or a portion thereof) fused to a $C_H3$ domain (or a portion thereof), a $C_H2$ domain (or a portion thereof) fused to both a hinge domain (or a portion thereof) and a $C_H$ domain (or a portion thereof). In still other examples, an Fc region lacks at least a portion of a $C_H2$ domain (e.g., all or part of a $C_H2$ domain). In a particular example, an Fc region can include amino acids corresponding 221 to 447 (based on the EU numbering system; see Edelman et al. (1969) PNAS 63:78-85 and Kabat et al. (1991) *Sequences of Proteins of Immunological Interest*, Fifth Edition, U.S. Department of Health and Human Services, NIH Publication No. 91-3242)

An Fc region for conjugation to any ADA2 provided herein can include, for example, a modification (e.g., an amino acid substitution) at one or more of the amino acid positions disclosed in International. PCT Pub. Nos. WO88/07089, WO96/14339, WO98/05787, WO98/23289, WO99/51642, WO99/58572, WO00/09560, WO00/32767, WO00/42072, WO02/44215, WO02/060919, WO03/074569, WO04/016750, WO04/029207, WO04/035752, WO04/063351, WO04/074455, WO04/099249, WO05/040217, WO04/044859, WO05/070963, WO05/077981, WO05/092925, WO05/123780, WO06/019447, WO06/047350, and WO06/085967; U.S. Pat. Publ. Nos. US 2007/0231329, US2007/0231329, US2007/0237765, US2007/0237766, US2007/0237767, US2007/0243188, US2007/0248603, US2007/0286859, US2008/0057056; or U.S. Pat. Nos. 5,648,260; 5,739,277; 5,834,250; 5,869,046; 6,096,871; 6,121,022; 6,194,551; 6,242,195; 6,277,375; 6,528,624; 6,538,124; 6,737,056; 6,821,505; 6,998,253; 7,083,784; 7,404,956; and 7,317,091, each of which is incorporated by reference herein in its entirety. In one example, the specific modification (e.g., the specific substitution of one or more amino acids disclosed in the art) can be made at one or more of the disclosed amino acid positions. In another example, a different change at one or more of the disclosed amino acid positions (e.g., the different substitution of one or more amino acid position disclosed in the art) can be made.

In some examples, any ADA2 provided herein can be conjugated to at least one Fc region as a fusion protein. Typically, such a fusion retains at least a functionally active hinge, $C_H2$ and $C_H3$ domains of the constant region of an immunoglobulin heavy chain. For example, a full-length Fc sequence of IgG1 includes amino acids 99-330 of the sequence set forth in SEQ ID NO:355. An exemplary Fc sequence for hIgG1 is set forth in SEQ ID NO:359, and contains almost all of the hinge sequence, and the complete sequence for the $C_H2$ and $C_H3$ domain as set forth in SEQ ID NO:355. Another exemplary Fc polypeptide is the Fc polypeptide set forth in SEQ ID NO:361. Another exemplary Fc polypeptide is set forth in PCT Pub. No. WO 93/10151, and is a single chain polypeptide extending from the N-terminal hinge region to the native C-terminus of the Fc region of a human IgG1 antibody (SEQ ID NO:359). The precise site at which the linkage is made is not critical: particular sites are well known and can be selected in order to optimize the biological activity, secretion, or binding characteristics of the ADA2 protein molecule. For example, other exemplary Fc polypeptide sequences begin at amino acid C109 or P113 of the sequence set forth in SEQ ID NO:355 (see e.g., U.S. Pub. No. 2006/0024298).

An Fc region for conjugation to any ADA2 provided herein can also contain amino acid substitution which alters the glycosylation of the chimeric protein known in the art. For example, the Fc region of any ADA2 provided herein can be conjugated to an Fc region having a mutation leading to reduced glycosylation (e.g., N- or O-linked glycosylation) or to an altered glycoform of the wild-type Fc moiety (e.g., a low fucose or fucose-free glycan).

An Fc region for conjugation to any ADA2 provided herein also can be engineered to include a tag with metal chelates or other epitope. The tagged domain can be used for rapid purification by metal-chelate chromatography, and/or by antibodies, to allow by detection of western blots, immunoprecipitation, or activity depletion/blocking in bioassays.

d. Albumin or Fragment, or Variant Thereof

An ADA2 conjugate provided herein can include an ADA2 that is linked, directly or indirectly, to a heterologous moiety that includes albumin or a functional fragment thereof. Human serum albumin (HSA, or HA), a protein of 609 amino acids in its full-length form (exemplary sequence set forth in SEQ ID NO:305), is responsible for a significant proportion of the osmotic pressure of serum and also functions as a carrier of endogenous and exogenous ligands. Albumin can be a full-length albumin or a functional fragment, variant, derivative, or analog thereof. Examples of albumin or the fragments or variants thereof are disclosed in US Pat. Publ. Nos. 2008/0194481, 2008/0004206, 2008/0161243, 2008/0261877, or 2008/0153751 or PCT Publ. Nos. 2008/033413, 2009/058322, or 2007/021494, each of which is incorporated by reference herein in its entirety.

In some examples, any ADA2 provided herein can include albumin, a fragment, or a variant thereof which is further linked to a heterologous moiety selected from an immunoglobulin constant region or portion thereof (e.g., an Fc region), a PAS sequence, HES, XTEN sequences, PEG, or any combinations thereof.

e. Albumin Binding Moiety

An ADA2 conjugate provided herein can include an ADA2 that is linked, directly or indirectly, to a heterologous moiety that is an albumin binding moiety, for example, an albumin binding peptide, a bacterial albumin binding domain, an albumin-binding antibody fragment, a fatty acid, or any combinations thereof.

For example, the albumin binding protein can be a bacterial albumin binding protein, an antibody or an antibody fragment including domain antibodies (see U.S. Pat. No. 6,696,245). An albumin binding protein, for example, can be a bacterial albumin binding domain, such as the one of a Streptococcal protein G (Konig, T. and A. Skerra, A. (1998) J Immunol. Methods 218:73-83). Other examples of albumin binding peptides that can be used to conjugate to any ADA2 provided herein are, for instance, those having a Cys-Xaa$_1$-Xaa$_2$-Xaa$_3$-Xaa$_4$-Cys consensus sequence (SEQ ID NO:306), wherein Xaa$_1$ is Asp, Asn, Ser, Thr, or Trp; Xaa$_2$ is Asn, Gln, His, Ile, Leu, or Lys; Xaa$_3$ is Ala, Asp, Phe, Trp, or Tyr; and Xaa$_4$ is Asp, Gly, Leu, Phe, Ser, or Thr (US Patent Pub. No. 2003/0069395; Dennis et al. (2002) J. Biol. Chem. 277: 35035-35043).

Domain 3 from Streptococcal protein G (Kraulis et al, (1996) FEBS Lett. 378:190-194; Linhult et al. (2002) Protein Sci. 11:206-213) is an example of a bacterial albumin-binding domain. Examples of albumin-binding peptides include a series of peptides having the core sequence DICLPRWGCLW (SEQ ID NO:307). (See, e.g., Dennis et al. (2002) J. Biol. Chem. 277: 35035-35043). Other examples of albumin-binding peptides include: RLIEDICLPRWGCLWEDD (SEQ ID NO:308); QRLMEDICLPRWGCLWEDDF (SEQ ID NO:309); QGLIGDICLPRWGCLWGDSVK (SEQ ID NO:310), and GEWWEDICLPRWGCLWEEED (SEQ ID NO:311).

Examples of albumin-binding antibody fragments that can be conjugated to any ADA2 provided herein include those disclosed in Muller and Kontermann, Curr. Opin. Mol. Ther. (2007) 9:319-326; Roovers et al. (2007), Cancer Immunol. Immunother. 56:303-317; Holt et al. (2008) Prot. Eng. Design Sci., 21:283-288, each of which is incorporated by reference herein in its entirety. An example of such albumin binding moiety is the 2-(3-maleimidopropanamido)-6-(4-(4-iodophenyl)butanamido) hexanoate ("Albu" tag) (Trussel et al. (2009) Bioconjugate Chem. 20:2286-2292).

Fatty acids, in particular long chain fatty acids (LCFA) and long chain fatty acid-like albumin-binding compounds can be used to extend the in vivo half-life of any ADA2 provided herein. An example of an LCFA-like albumin-binding compound is 16-(1-(3-(9-(((2,5-dioxopyrrolidin-1-yloxy) carbonyloxy)-methyi)-7-sulfo-9H-fluoren-2-ylamino)-3-oxopropyl)-2,5-dioxopyrrolidin-3-ylthio) hexadecanoic acid (see, e.g., WO 2010/140148).

f. PAS Sequences

An ADA2 conjugate provided herein can include an ADA2 that is linked, directly or indirectly, to at least one heterologous moiety that is a PAS sequence, which is an amino acid sequence that includes mainly alanine and serine residues or that includes mainly alanine, serine, and proline residues. The amino acid sequences form random coil conformation under physiological conditions. Accordingly, the PAS sequence is a building block, an amino acid polymer, or a sequence cassette made of alanine, serine, and proline, which can be used as a part of the heterologous moiety conjugated to any ADA2 provided herein.

One of skilled in the art is aware that an amino acid polymer also can form a random coil conformation when residues other than alanine, serine, and proline are added as a minor constituent in the PAS sequence. Minor constituents include amino acids other than alanine, serine, and proline that can be added in the PAS sequence to a certain degree, e.g., up to about 12%, i.e., about 12 of 100 amino acids of the PAS sequence, up to about 10%, i.e. about 10 of 100 amino acids of the PAS sequence, up to about 9%, i.e., about 9 of 100 amino acids, up to about 8%, i.e., about 8 of 100 amino acids, about 6%, i.e., about 6 of 100 amino acids, about 5%, i.e., about 5 of 100 amino acids, about 4%, i.e., about 4 of 100 amino acids, about 3%, i.e., about 3 of 100 amino acids, about 2%, i.e., about 2 of 100 amino acids, or about 1%, i.e., about 1 of 100 of the amino acids. The amino acids different from alanine, serine and proline can be selected from Arg, Asn, Asp, Cys, Gln, Glu, Gly, His, Ile, Leu, Lys, Met, Phe, Thr, Trp, Tyr, or Val.

Under physiological conditions, the PAS sequence stretch forms a random coil conformation and thereby can mediate an increased in vivo and/or in vitro stability to any ADA2 provided herein. Since the random coil domain does not adopt a stable structure or function by itself, the biological activity mediated by any ADA2 provided herein is essentially preserved. In other examples, the PAS sequences that form random coil domains are biologically inert, especially with respect to proteolysis in blood plasma, immunogenicity, isoelectric point/electrostatic behavior, binding to cell surface receptors or internalization, but are still biodegradable, which provides clear advantages over synthetic polymers such as PEG Non-limiting examples of the PAS sequences forming random coil conformation include an amino acid sequence such as ASPAAPAPASPAAPAPSAPA (SEQ ID NO:312), AAPASPAPAAPSAPAPAAPS (SEQ ID NO:313), APSSPSPSAPSSPSPASPSS (SEQ ID NO:314), APSSPSPSAPSSPSPASPS (SEQ ID NO:315), SSPSAPSPSSPASPSPSSPA (SEQ ID NO:316), AASPAAPSAPPAAASPAAPSAPPA (SEQ ID NO:317), ASAAAPAAASAAASAPSAAA (SEQ ID NO:318) or any combinations thereof. Additional examples of PAS sequences are known in the art (see, e.g., US Pat. Publ. No. 2010/0292130 and International PCT Publ. No. WO 2008/155134)

g. HAP Sequences

An ADA2 conjugate provided herein can include an ADA2 that is linked, directly or indirectly, to at least one heterologous moiety that is a glycine-rich homo-amino-acid polymer (HAP). The HAP sequence can include a repetitive sequence of glycine, which has at least 50 amino acids, at least 100 amino acids, 120 amino acids, 140 amino acids, 160 amino acids, 180 amino acids, 200 amino acids, 250 amino acids, 300 amino acids, 350 amino acids, 400 amino acids, 450 amino acids, or 500 amino acids in length. In one example, the HAP sequence is capable of extending half-life of a moiety fused to or linked to the HAP sequence. Non-limiting examples of the HAP sequence includes, but are not limited to (Gly)$_n$(SEQ ID NO:368), (Gly$_4$Ser)$_n$(SEQ ID NO:343) or Ser(Gly$_4$Ser)$_n$(SEQ ID NO:595), wherein n is 1, 2, 3, 4, 5, 6, 7, 8, 9, 10, 11, 12, 13, 14, 15, 16, 17, 18, 19, or 20. In one example, n is 20, 21, 22, 23, 24, 25, 26, 26, 28, 29, 30, 31, 32, 33, 34, 35, 36, 37, 38, 39, or 40. In another example, n is 50, 60, 70, 80, 90, 100, 110, 120, 130, 140, 150, 160, 170, 180, 190, or 200.

h. XTEN Sequences

An ADA2 conjugate provided herein can include an ADA2 that is linked, directly or indirectly, to at least one heterologous moiety that includes an XTEN sequence, polypeptide or fragment, variant, or derivative thereof. XTEN sequence is an extended length polypeptide sequence with non-naturally occurring, substantially non-repetitive sequences that are composed mainly of small hydrophilic amino acids, with the sequence having a low degree or no secondary or tertiary structure under physiologic conditions (Schellenberger et al. (2009) Nat Biotechnol. 27(12):1186-1190). An exemplary XTEN sequence is an unstructured recombinant polypeptide of 864 amino acids (SEQ ID NO:373), which extends the plasma half-life of the protein fused to the moiety. As a heterologous moiety, XTEN sequences can function as a half-life extension moiety. In addition, XTEN sequences can provide desirable properties including, but are not limited to, enhanced pharmacokinetic parameters and solubility characteristics. For example, conjugation of XTEN sequences to any ADA2 provided herein can confer one or more of the following advantageous properties: conformational flexibility, enhanced aqueous solubility, high degree of protease resistance, low immunogenicity, low binding to mammalian receptors, or increased hydrodynamic (or Stokes) radii. In some examples, an XTEN sequence can increase pharmacokinetic properties such as longer in vivo half-life or increased area under the curve (AUC), such that any ADA2 provided herein stays in vivo and retains adenosine deaminase activity for an increased period of time compared to the same ADA2 without the XTEN heterologous moiety.

Examples of XTEN sequences that can be used as heterologous moieties conjugated to any ADA2 provided herein include any of those described in U.S. Pat. Nos. 7,855,279 and 7,846,445, U.S. Patent Publication Nos. 2009/0092582, 2010/0239554, 2010/0323956, 2011/0046060, 2011/0046061, 2011/0077199, 2011/0172146, 2012/0178691, 2013/0017997, or 2012/0263701, or International Patent Publication Nos. WO 2010091122, WO 2010144502, WO 2010144508, WO 2011028228, WO 2011028229, or WO 2011028344, each of which is incorporated by reference herein in its entirety.

i. Transferrin or Fragment Thereof

An ADA2 conjugate provided herein can include an ADA2 that is linked, directly or indirectly, to at least one heterologous moiety that is a transferrin or a fragment thereof. Any transferrin can be conjugated to any ADA2 provided herein. For example, wildtype human Tf (Tf) is a 679 amino acid protein (amino acid sequence set forth in SEQ ID NOS:320 and 324; GenBank Acc. Nos. NP 001054.1 and AAB22049.1; nucleic acid sequence set forth in SEQ ID NOS:319 and 322-323, GenBank Acc. Nos. NM001063, M12530, XM039845, and S95936), of approximately 75 kDa (excluding glycosylation), with two main domains, the N terminal domain (about 330 amino acids) and the C terminal domain (about 340 amino acids), which appear to originate from a gene duplication. The N domain includes two subdomains, N1 domain and N2 domain, and the C domain includes two subdomains, C1 domain and C2 domain.

In one example, the transferrin heterologous moiety includes a transferrin splice variant. In one example, a transferrin splice variant can be a splice variant of human transferrin (SEQ ID NO:325; Genbank Acc. No. AAA61140). In another example, the transferrin portion of the chimeric protein includes one or more domains of the transferrin sequence, e.g., N domain, C domain, N1 domain, N2 domain, C1 domain, C2 domain or any combinations thereof.

j. Polymer Conjugation

An ADA2 conjugate provided herein can include an ADA2 that is linked, directly or indirectly, to at least one heterologous moiety that is a polymeric molecule (polymer).

Exemplary of polymers are such as polyols (i.e., poly-OH), polyamines (i.e., poly-$NH_2$) and polycarboxyl acids (i.e., poly-COOH), and further heteropolymers i.e., polymers containing one or more different coupling groups e.g., a hydroxyl group and amine groups. Examples of suitable polymeric molecules include polymeric molecules selected from among polyalkylene oxides (PAO), such as polyalkylene glycols (PAG), including polyethylene glycols (PEG), ethylene glycol/propylene glycol copolymers, methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, polyoxazoline, polyacryloylmorpholine, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates, bio-polymer, and those disclosed in the art, for example, in U.S. Pat. No. 8,741,283 and International PCT Publication No. WO 2007/149686.

For example, polymer conjugated to any ADA2 provided herein can generally correspond to the following formula:

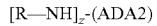

wherein (ADA2) represents any ADA2 described herein, such as wildtype, variants or modified forms thereof;

NH— is an amino group of an amino acid found on the ADA2 provided herein for the attachment to the polymer;

z is a positive integer, such as from about 1 to about 32, or 1-3, 2-4, 3-5, 4-6, 5-7, 6-8, 7-9, 8-10, 9-11, 10-12, 11-13, 12-14, 13-15, 14-16, 15-17, 16-18, 17-19, 18-20, 19-21, 20-22, 21-23, 22-24, 23-25, 24-26, 25-27, 26-28, 27-29, 28-30, 29-31 or 30-32;

R is a substantially non-antigenic polymer molecule that is attached to the ADA2 provided herein in a releasable or non-releasable form. Exemplary non-antigenic polymeric molecule can be any described herein and those disclosed in the art, for example, in U.S. Pat. No. 8,741,283 and International PCT Publication No. WO 2007/149686.

For example, any ADA2 described herein can be conjugated to least one polyethylene glycol (PEG) molecule. In some examples, the polymer can be water-soluble. In some examples, any ADA2 provided herein is conjugated to a PEG heterologous moiety and further includes a heterologous moiety selected from an immunoglobulin constant region or portion thereof (e.g., an Fc region), a PAS sequence, hydroxyethyl starch (HES) and albumin or fragment or variant thereof, an XTEN sequence, or any combinations thereof.

Covalent or other stable attachment (conjugation) of polymeric molecules, such as polyethylene glycol (PEGylation moiety (PEG)), to any ADA2 polypeptide, including variant ADA2 polypeptides, impart beneficial properties to the resulting ADA2-polymer composition. Such properties include improved biocompatibility, extension of protein (and enzymatic activity) half-life in the plasma, cells and/or in other tissues within a subject, effective shielding of the protein from proteases and hydrolysis, improved biodistribution, enhanced pharmacokinetics and/or pharmacodynamics, increased stability, decreased immunogenicity, prolonged/sustained treatment effects in a subject, and increased water solubility (see U.S. Pat. No. 4,179,337).

i. Polyethylene Glycol (PEG)

Polyethylene glycol (PEG) has been widely used in biomaterials, biotechnology and medicine primarily because PEG is a biocompatible, nontoxic, water-soluble polymer that is typically nonimmunogenic (Zhao and Harris, *ACS*

Symposium Series 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, Adv. Drug Del. Rev. 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al., Macromolecules 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., Eur. Polym J. 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, N-hydroxysuccinimidyl (NHS) activated PEG; succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG; mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J. Bioactive Compatible Polymers 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. Pat. No. 5,324,844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. Pat. No. 8,741,283; US 2001/0021763; US 2001/0044526; US 2001/0046481; US 2002/0052430; US 2002/0072573; US 2002/0156047; US 2003/0114647; US 2003/0143596; US 2003/0158333; US 2003/0220447; US 2004/0013637; US 2004/0235734; WO 05000360; US 2005/0114037; US 2005/0171328; US 2005/0209416; EP 1064951; EP 0822199; WO 01076640; WO 0002017; WO 0249673; WO 94/28024; and WO 01/87925).

In particular, the polymer is a polyethylene glycol (PEG). Suitable polymeric molecules for attachment to any ADA2 polypeptide, including variant ADA2 polypeptides, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g., Roberts et al., Advanced Drug Delivery Review (2002) 54: 459-476; Harris and Zalipsky, S (eds.) "Poly(ethylene glycol), Chemistry and Biological Applications" ACS Symposium Series 680, 1997; Mehvar et al., J. Pharm. Pharmaceut. Sci., 3(1):125-136, 2000; Harris, (2003) Nature Reviews Drug Discovery 2:214-221; and Tsubery, (2004) J Biol. Chem 279(37):38118-24).

The polymeric moiety, such as the PEG moiety, can be of a molecular weight typically ranging from about 1 kDa to about 100 kDa. In some embodiments the polymeric molecule that is conjugated to a protein, such as any ADA2 provided herein, has a molecular weight of at least or at least about or 5, 10, 15, 20, 25, 30, 35, 40, 45, 50, 55, 60, 65, 70, 75, 80, 85, 90, 95, 100 kDa or more than 1000 kDa. Other sizes can be used, depending on the desired profile (e.g., the duration of sustained release desired, the effects, if any on biological activity, the ease in handling, the degree or lack of antigenicity and other known effects of the polyethylene glycol to a protein or analog).

The PEG moiety can be of any molecular weight, and can be branched or unbranched. In some examples, the heterologous polymer is a PEG with a branched structure. Branched polyethylene glycols are described, for example, in U.S. Pat. No. 5,643,575; Morpurgo et al. (1996) Appl. Biochem. Biotechnol. 56:59-72; Vorobjev et al. (1999) Nucleosides Nucleotides 18:2745-2750; and Caliceti et al. (1999) Bioconjug. Chem. 10:638-646, each of which is incorporated herein by reference in its entirety.

While numerous reactions have been described for PEGylation, those that are most generally applicable confer directionality, utilize mild reaction conditions, and do not necessitate extensive downstream processing to remove toxic catalysts or byproducts. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysine residue, but other amines also can react (e.g. the N-terminal alpha-amine or the ring amines of histidine) if local conditions are favorable.

A more directed attachment is possible in proteins containing a single lysine or cysteine. The latter residue can be targeted by PEG-maleimide for thiol-specific modification. Alternatively, PEG hydrazide can be reacted with a periodate oxidized protein and reduced in the presence of NaCNBH$_3$. More specifically, PEGylated CMP sugars can be reacted with a protein in the presence of appropriate glycosyl-transferases. Alternatively, pegyaltion of ADA2 can occur in variants containing substitutions with non-natural amino acids that allow for site-specific chemical conjugation at optimized positions within the protein. PEGylation techniques can allow where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially can cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated ADA2 polypeptides provided herein, including variant ADA2 polypeptides, PEG moieties are conjugated, via covalent attachment, to the polypeptides. Techniques for PEGylation include, but are not limited to, specialized linkers and coupling chemistries (see e.g., Roberts et al., *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002). Methods and techniques described in the art can produce proteins having at least 1, 2, 3, 4, 5, 6, 7, 8, 9, 10 or more than 10 PEG or PEG derivatives attached to a single protein molecule (see e.g., U.S. 2006/0104968).

The number of polyethylene glycol moieties attached to each ADA2 molecule can also vary. For example, any ADA2 provided herein can be conjugated to, on average, at least 1, 2, 3, 4, 5, 6, 7, 8, 9, 10, 12, 15, 17, 20, 25, 30 or more polyethylene glycol molecules. For example, the PEGylated ADA2 polypeptides, including variant ADA2 polypeptides generally contains at least 5 PEG moieties per molecule. In other examples, the range of number of PEG molecules per protein molecule can be 1-3, 2-4, 3-5, 4-6, 5-7, 6-8, 7-9, 8-10, 9-11, 10-12, 11-13, 12-14, 13-15, 14-16, 15-17, 16-18, 17-19, 18-20, 19-21, 20-22, 21-23, 22-24, 23-25, 24-26, 25-27, 26-28, 27-29, 28-30, 29-31 or 30-32. For example, the ADA2 polypeptides, including variant ADA2 polypeptides can have a PEG to protein molar ratio between 32:1 and 1:1, such as about or up to 30:1, 20:1, 15:1, 10:1 and 5:1. The number of PEG molecules per protein can be varied in order to modify the physical and kinetic properties of the combined conjugate to fit any particular clinical situation, as determined by one of skill in the art. Methods for determining the PEG to protein molar ratio is disclosed in the art, for example, in Delgado et al. (1992) Crit. Rev. Thera. Drug Carrier Sys. 9:249-304).

Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions. Various methods of modifying polypeptides by covalently attaching (conjugating) a PEG or PEG derivative (i.e., "PEGylation") are known in the art (see e.g., U.S. Pat. No. 5,672,662; U.S. Pat. No. 6,737,505; U.S. 2004/0235734; U.S. 2006/0104968). Covalent attachment of a variety of polymers, such as PEG or PEG derivatives, is described in U.S. Pat. No. 8,741,283.

Activated polymers and derivatives can be employed to facilitate the conjugation of the polymer to any ADA2 provided herein. Activated polymers and derivatives have a leaving or activating group, which facilitates the attachment of the polymer system to an amine group found on the polypeptide, such as an ADA2 provided herein. For example, activated groups are those groups which are capable of reacting with an amine group (nucleophile) found on any ADA2 provided herein, such as the epsilone amine group of lysine. Exemplary activating groups include:

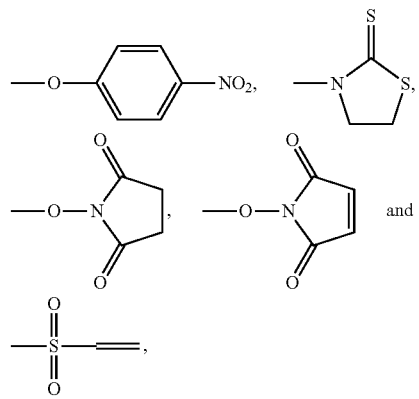

and other suitable leaving or activating groups such as N-hydroxybenzotriazolyl, halogen, N-hydroxyphthalimidyl, imidazolyl, O-acyl ureas, pentafluorophenol, 2,4,6-tri-chlorophenol or other suitable leaving groups apparent to one of skill in the art.

Exemplary activated PEGs include, for example, those disclosed in the art, such as in U.S. Pat. Nos. 5,122,614, 5,324,844, 5,612,460 and 5,808,096 (succinimidyl carbonate-activated polyethylene glycol (SC-PEG) and related activated PEGs), and U.S. Pat. No. 5,349,001 (cyclic imide thione activated PEGs). Conjugation reactions typically are carried out in a suitable buffer using a several-fold molar excess of activated PEG. In some examples, conjugates are made with linear PEGs, such as SC-PEG; and can contain, on average, from about 1 to about 32 PEG molecules per protein molecule. Consequently, for these, molar excesses of several hundred fold, e.g., about 200 to about 1000-fold can be employed. The molar excess used for branched polymers and polymers attached to the enzyme will be lower and can be determined using the techniques known in the art.

In some examples, the activated polymer linkers of the polymeric systems based on benzyl elimination or trimethyl lock lactonization, as described in U.S. Pat. Nos. 6,180,095, 6,720,306, 5,965,119, 6,624,142 and 6,303,569. In other examples, polymer conjugation of any ADA2 provided herein can be achieved using bicine polymer residues, as described in the art, for example, in U.S. Pat. Nos. 7,122, 189, 7,087,229 and 8,741,283. In other examples, polymer conjugation of any ADA2 provided herein can be achieved using branched polymer residues, such as those described in U.S. Pat. Nos. 5,681,567, 5,756,593, 5,643,575; 5,919,455, 6,113,906, 6,153,655, 6,395,266 and 6,638,499, 6,251,382, 6,824,766, and 8,741,283. In other examples, polymer conjugation of any ADA2 provided herein can be achieved using a hindered ester-based linker, such as those described in International PCT Pub. No. WO 2008/034119. In some examples, the activated polyethylene glycol is one which provides a urethane linkage or amide-linkage with the protein such as any ADA2 provided herein.

Methods of preparing polymers having terminal carboxylic acids in high purity are described in the art, for example in U.S. Pat. Pub. No. 2007/0173615. The methods include first preparing a tertiary alkyl ester of a polyalkylene oxide followed by conversion to the carboxylic acid derivative thereof. The first step of the preparation of the PAO carboxylic acids of the process includes forming an intermediate such as t-butyl ester of polyalkylene oxide carboxylic acid. This intermediate is formed by reacting a PAO with a t-butyl haloacetate in the presence of a base such as potassium t-butoxide. Once the t-butyl ester intermediate has been formed, the carboxylic acid derivative of the polyalkylene oxide can be readily provided in purities exceeding 92%, such as exceeding 97%, 99%, or 99.5%.

In other examples, polymers having terminal amine groups can be employed to make conjugates to ADA2 provided herein. The methods of preparing polymers containing terminal amines in high purity are described in the art, for example in U.S. Pat. Nos. 7,868,131 and 7,569,657. For example, polymers having azides react with phosphine-based reducing agent such as triphenylphosphine or an alkali metal borohydride reducing agent such as $NaBH_4$. Alternatively, polymers including leaving groups react with protected amine salts such as potassium salt of methyl-tert-butyl imidodicarbonate (KNMeBoc) or the potassium salt of di-tert-butyl imidodicarbonate ($KNBoc_2$) followed by deprotecting the protected amine group. The purity of the polymers containing the terminal amines formed by these processes is greater than about 95%, such as greater than 99%.

In some examples, the PEG portion of the polymer conjugate of ADA2 provided herein can be selected from among:

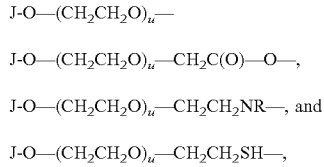

where u is the degree of polymerization, i.e. from about 10 to about 2,300;

R is selected from among hydrogen, $C_{1-6}$ alkyls, $C_{2-6}$ alkenyls, $C_{2-6}$ alkynyls, $C_{3-12}$ branched alkyls, $C_{3-8}$ cycloalkyls, $C_{1-6}$ substituted alkyls, $C_{2-6}$ substituted alkenyls, $C_{2-6}$ substituted alkynyls, $C_{3-8}$ substituted cycloalkyls, aryls substituted aryls, aralkyls, $C_{1-6}$ heteroalkyls, substituted $C_{1-6}$ heteroalkyls, $C_{1-6}$ alkoxy, phenoxy and $C_{1-6}$ heteroalkoxy, and J is a capping group, i.e., a group which is found on the terminal of the polymer and, in some aspects, can be selected from among $NH_2$ (or $CH_2CH_2NH_2$), H, SH (or $CH_2CH_2SH$), $CO_2H$ (or $CH_2CO_2H$), $C_{1-6}$ alkyls, such as a methyl, or other PEG terminal activating groups known in the art.

For example, the PEG portion of the polymer conjugate can be selected from among $CH_3$—O—$(CH_2CH_2O)_u$—, $CH_3$—O—$(CH_2CH_2O)_u$—$CH_2C(O)$—O—, $CH_3$—O—$(CH_2CH_2O)_u$—$CH_2CH_2NH$— and $CH_3$—O—$(CH_2CH_2O)_u$—$CH_2CH_2SH$—, where u is a positive integer, such that the average total molecular weight of the polymer portion ranges from about 2 kDa to about 100 kDa.

In other examples, the PEG portion of the polymer conjugate of ADA2 provided herein can be selected from among:

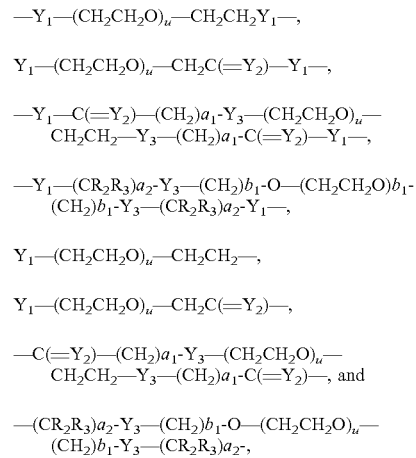

wherein: $Y_1$ and $Y_3$ are independently O, S, SO, $SO_2$, $NR_4$ or a bond;

$Y_2$ is O, S, or $NR_5$;

$R_2$-$R_5$ are independently selected from among hydrogen, $C_{1-6}$ alkyl, $C_{2-6}$ alkenyl, $C_{2-6}$ alkynyl, $C_{3-19}$ branched alkyl, $C_{3-8}$ cycloalkyl, $C_{1-6}$ substituted alkyl, $C_{2-6}$ substituted alkenyl, $C_{2-6}$ substituted alkynyl, $C_{3-8}$ substituted cycloalkyl, aryl, substituted aryl, heteroaryl, substituted heteroaryl, $C_{1-6}$ heteroalkyl, substituted $C_{1-6}$ heteroalkyl, $C_{1-6}$ alkoxy, aryloxy, $C_{1-6}$ heteroalkoxy, heteroaryloxy, $C_{2-6}$ alkanoyl, arylcarbonyl, $C_{2-6}$ alkoxycarbonyl, aryloxycarbonyl, $C_{2-6}$ alkanoyloxy, arylcarbonyloxy, $C_{2-6}$ substituted alkanoyl, substituted arylcarbonyl, $C_{2-6}$ substituted alkanoyloxy, substituted aryloxycarbonyl, $C_{2-6}$ substituted alkanoyloxy and substituted arylcarbonyloxy;

$a_1$, $a_2$, and $b_1$ are independently zero or a positive integer from 1 to 6, for example, 0, 1 or 2; and u is an integer from about 10 to about 2300.

In other examples, the PEG portion of the polymer conjugate of $ADA_2$ provided herein can be functionalized, for example, in the following manner:

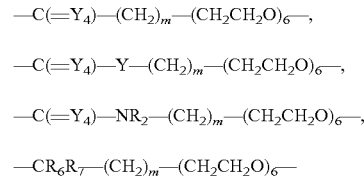

wherein: $R_2$, $R_6$ and $R_7$ are independently selected from among H, $C_{1-6}$ alkyls, aryls, substituted aryls, aralkyls, heteroalkyls, substituted heteroalkyls and substituted $C_{1-6}$ alkyls;

m is zero or is a positive integer, such as 1 or 2, $Y_4$ is O or S; and u represents the degree of polymerization.

In some examples, the polymer conjugates of ADA2 provided herein can be made by methods which include converting the multi-arm PEG-OH or "star-PEG" products, such made by NOF Corp, Tokyo, Japan, into a suitably activated polymer, using the activation techniques described in U.S. Pat. No. 5,122,614 or 5,808,096. In one example, the multi-arm polymers can contain four or more polymer arms and preferably four or eight polymer arms. In some examples, four of the PEG arms are converted to suitable functional groups, such as succinimidyl carbonate (SC), for facilitating attachment to the polypeptide, such as any ADA2 provided herein.

The polymeric conjugates provided herein can be water-soluble at room temperature. A non-limiting list of such polymers include polyalkylene oxide homopolymers such as polyethylene glycol (PEG) or polypropylene glycols, polyoxyethylenated polyols, copolymers thereof and block copolymers thereof.

As an exemplary illustrative method for making PEGylated ADA2 polypeptides, including variant ADA2 polypeptides, PEG aldehydes, succinimides and carbonates have each been applied to conjugate PEG moieties, typically succinimidyl PEGs. Exemplary succinimidyl monoPEG (mPEG) reagents including mPEG-Succinimidyl Propionates (mPEG-SPA), mPEG Succinimidyl Carboxymethyl Ester (mPEG-SCM), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to ADA2 during the conjugation process. Such PEGylated ADA2 compositions can be readily purified to yield compositions having at least about 90% to about 100% PEGylated ADA2 molecules, and being substantially free of non-PEGylated ADA2 (less than 5% non-PEGylated).

In one example, the PEGylation includes conjugation of mPEG-SCM, for example, mPEG-SCM-20K (having a molecular weight of about 20 kDa) or another succinimidyl carboxymethyl esters of PEG derivative, to any ADA2 polypeptide, including variant ADA2 polypeptides. Succinimidyl carboxymethyl esters of PEG derivatives, such as mPEG-SCM-20K readily couple to amino groups of lysines in proteins or the N-terminal amine in biological active molecules. For example, covalent conjugation of m-PEG-SCM-20K and ADA2 (which is approximately 59 kDa in size as a monomer) provides stable amide bonds between ADA2 and mPEG. Typically, the mPEG-SCM-20K or other PEG is added to any ADA2 polypeptide, including variant ADA2 polypeptides, at a PEG:polypeptide molar ratio of 15:1 in a suitable buffer, followed by sterilization, e.g., sterile filtration, and continued conjugation, for example, with stirring, overnight at 4° C. in a cold room.

Other methods of coupling succinimidyl esters of PEG, including butanoic acid derivatives such as mPEG-SBA-30K, to a polypeptide are known in the art (see e.g., U.S. Pat. No. 5,672,662; U.S. Pat. No. 6,737,505; U.S. Pat. No. 8,784,791; U.S. 2004/0235734 and U.S. 2005/0158273). For example, a polypeptide, such as any ADA2 provided herein, can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration or using resin columns such as Capto Phenyl resin columns (GE Healthcare). Another method reacts polypeptide with mPEG-SBA in deionized water to which triethylamine is added to raise the pH to 7.2-9. The resulting mixture is stirred at room temperature for several hours to complete the PEGylation.

As shown herein, PEGylation of variant ADA2 confers reduction in heparin binding property to the ADA2. The reduction in heparin binding can be in addition to any attenuated heparin binding resulting from amino acid replacement(s) that reduce heparin binding. Thus, PEGylation of ADA2 also improves pharmacokinetic properties of the ADA2, and PEGylation can be used in place of or in addition to amino acid replacement(s) to attenuate heparin binding.

ii. Hydroxyethyl Starch (HES)

In some examples, at least one heterologous moiety is a polymer, e.g., hydroxyethyl starch (HES) or a derivative thereof. Hydroxyethyl starch (HES) is a derivative of naturally occurring amylopectin and is degraded by alpha-amylase in the body. HES is a substituted derivative of the carbohydrate polymer amylopectin, which is present in corn starch at a concentration of up to 95% by weight. HES exhibits advantageous biological properties and is used as a blood volume replacement agent and in hemodilution therapy in the clinics.

Amylopectin contains glucose moieties, wherein in the main chain $\alpha$-1,4-glycosidic bonds are present and at the branching sites $\alpha$-1,6-glycosidic bonds are found. The physical-chemical properties of this molecule are mainly determined by the type of glycosidic bonds. Due to the nicked $\alpha$-1,4-glycosidic bond, helical structures with about six glucose-monomers per turn are produced. The physico-chemical as well as the biochemical properties of the polymer can be modified via substitution. The introduction of a hydroxyethyl group can be achieved via alkaline hydroxyethylation. By adapting the reaction conditions it is possible to exploit the different reactivity of the respective hydroxy group in the unsubstituted glucose monomer with respect to hydroxyethylation. One of skill in the art can determine the substitution pattern. HES is mainly characterized by the molecular weight distribution and the degree of substitution (DS), which refers to the molar ratio of the substitution.

In one example, hydroxyethyl starch has a mean molecular weight (weight mean) of from 1 to 300 kD, from 2 to 200 kD, from 3 to 100 kD, or from 4 to 70 kD. Hydroxyethyl starch can further exhibit a molar degree of substitution (DS) of from 0.1 to 3, preferably 0.1 to 2, more preferred, 0.1 to 0.9, preferably 0.1 to 0.8, and a ratio between C2:C6 substitution in the range of from 2 to 20 with respect to the hydroxyethyl groups. A non-limiting example of HES having a mean molecular weight of about 130 kD is a HES with a DS of 0.2 to 0.8, such as 0.2, 0.3, 0.4, 0.5, 0.6, 0.7, or 0.8, and in particular, a DS of 0.4 to 0.7 such as 0.4, 0.5, 0.6, or 0.7.

In one example, the HES can have a mean molecular weight of about 130 kD, and is VOLUVEN® (Fresenius Kabi, Germany). VOLUVEN® is an artificial colloid, employed, e.g., for volume replacement used in the therapeutic indication for therapy and prophylaxis of hypovolemia. The characteristics of VOLUVEN® are a mean molecular weight of 130±20 kDa, with a molar substitution of 0.4 and a C2:C6 ratio of about 9:1. In other examples, ranges of the mean molecular weight of hydroxyethyl starch are, e.g., 4 to 70 kDa or 10 to 70 kDa or 12 to 70 kDa or 18 to 70 kDa or 50 to 70 kDa or 4 to 50 kDa or 10 to 50 kDa or 12 to 50 kDa or 18 to 50 kDa or 4 to 18 kDa or 10 to 18 kDa or 12 to 18 kDa or 4 to 12 kDa or 10 to 12 kDa or 4 to 10 kDa. In other examples, the mean molecular weight of hydroxyethyl starch employed is in the range of from more than 4 kDa and below 70 kDa, such as about 10 kDa, or in the range of from 9 to 10 kDa or from 10 to 11 kDa or from 9 to 11 kDa, or about 12 kDa, or in the range of from 11 to 12 kDa) or from 12 to 13 kDa or from 11 to 13 kDa, or about 18 kDa, or in the range of from 17 to 18 kDa or from 18 to 19 kDa or from 17 to 19 kDa, or about 30 kDa, or in the range of from 29 to 30, or from 30 to 31 kDa, or about 50 kDa, or in the range of from 49 to 50 kDa or from 50 to 51 kDa or from 49 to 51 kDa.

In some examples, the heterologous moiety can be a mixture of hydroxyethyl starches having different mean molecular weights and/or different degrees of substitution and/or different ratios of C2: C6 substitution. Therefore, mixtures of hydroxyethyl starches can be employed having different mean molecular weights and different degrees of substitution and different ratios of C2: C6 substitution, or having different mean molecular weights and different degrees of substitution and the same or about the same ratio of C2:C6 substitution, or having different mean molecular weights and the same or about the same degree of substitution and different ratios of C2:C6 substitution, or having the same or about the same mean molecular weight and different degrees of substitution and different ratios of C2:C6 substitution, or having different mean molecular weights and the same or about the same degree of substitution and the same or about the same ratio of C2:C6 substitution, or having the same or about the same mean molecular weights and different degrees of substitution and the same or about the same ratio of C2:C6 substitution, or having the same or about the same mean molecular weight and the same or about the same degree of substitution and different ratios of C2:C6 substitution, or having about the same mean, molecular weight and about the same degree of substitution and about the same ratio of C2:C6 substitution.

iii. Polysialic Acids (PSA)

In certain examples, at least one heterologous moiety is a polymer, e.g., polysialic acids (PSAs) or a derivative thereof. Polysialic acids (PSAs) are naturally occurring unbranched polymers of sialic acid produced by certain bacterial strains and in mammals in certain cells (Roth J., et al. (1993) in Polysialic Acid: From Microbes to Man, eds Roth J., Rutishauser U., Troy F. A. (Birkhauser Verlag, Basel, Switzerland), pp 335-348). They can be produced in various degrees of polymerization from about 80 or more sialic acid residues to about 2, by limited acid hydrolysis or by digestion with neuraminidases, or by fractionation of the natural, bacterially derived forms of the polymer.

The composition of different polysialic acids also varies such that there are homopolymeric forms i.e. the α-2,8-linked polysialic acid of the capsular polysaccharide of *E. coli* strain K1 and the group-B meningococci, which is also found on the embryonic form of the neuronal cell adhesion molecule (N-CAM). Heteropolymeric forms also exist, such as the alternating α-2,8 α-2,9 polysialic acid of *E. coli* strain K92 and group C polysaccharides of *N. meningitidis*. Sialic acid can also be found in alternating copolymers with monomers other than sialic acid such as group W135 or group Y of *N. meningitidis*. Polysialic acids have important biological functions including the evasion of the immune and complement systems by pathogenic bacteria and the regulation of glial adhesiveness of immature neurons during fetal development (wherein the polymer has an anti-adhesive function) (Cho and Troy, (1994) P.N.A.S. 91:11427-11431), although there are no known receptors for polysialic acids in mammals.

In other examples, the α-2,8-linked polysialic acid of *E. coli* strain K1, also known as colominic acid, are used (in various lengths). Various methods of attaching or conjugating polysialic acids to a polypeptide have been described (see e.g., U.S. Pat. No. 5,846,951; WO 01/87922, and US 2007/0191597, each of which is incorporated herein by reference in its entirety).

iv. Other Polymers

In other examples, the polymer moiety for conjugation to any ADA2 provided herein can be selected from among one or more effectively non-antigenic materials such as dextran, polyvinyl alcohols, carbohydrate-based polymers, hydroxypropylmeth-acrylamide (HPMA), polyalkylene oxides, and/or copolymers thereof, including other polymers known in the art and/or described in U.S. Pat. No. 6,153,655. It is within the level of one of skill in the art to select the polymer based on the purpose of use, and to select the suitable conjugation methods.

2. Methods of Producing Conjugates or Fusion Proteins

Heterologous moieties can be conjugated directly or indirectly to any ADA2 provided herein. For example, the heterologous moieties can be conjugated in a post-translational manner, after the recombinant production of the ADA2 polypeptide, by direct chemical linkage or indirectly via a linker. In other examples, heterologous moieties that are protein or polypeptide moieties, can be directly or indirectly conjugated to any ADA2 provided herein. In one example, the protein or polypeptide moieties can be directly linked, for example, as a fusion protein. In other examples, the heterologous moiety is conjugated indirectly, via a linker. In other examples, the heterologous moiety can be linked by disulfide bonds formed between a thiol group in the heterologous moiety and the cysteine residues in the ADA2 provided herein.

Linkers

Linkers, or spacers, can be used to connect heterologous moieties and polypeptides, such as any ADA2 provided herein. A linker refers to a peptide or polypeptide sequence (e.g. a synthetic peptide or polypeptide sequence), or a non-peptide linker for which its main function is to connect two moieties, such as an ADA2 provided herein and the heterologous moiety. Linkers can be used to maintain the structural flexibility and other conformational characteristics of the individual residues or at the secondary, tertiary, or quaternary structural levels of domains or moieties of the polypeptide conjugate or fusion protein, in order to maintain functional properties of the moieties. Linkers can also provide additional beneficial properties to the polypeptide conjugate or fusion protein, such as increased protein expression in mammalian expression systems, improved biophysical properties such as stability and solubility, improved protein purification and detection and/or increased enzymatic activity. In some examples, two or more linkers can be linked in tandem. Linkers can be peptide linkers that link a protein or polypeptide moiety to the ADA2 polypeptide. Other exemplary linkers include chemical linking agents and heterobifunctional linking agents.

When multiple linkers are present between the ADA2 and the heterologous moiety, each of the linkers can be the same or different. Generally, linkers provide flexibility to the polypeptide molecule. Linkers are not typically cleaved; however in certain examples, such cleavage can be desirable. Accordingly, in some embodiments a linker can contain one or more protease-cleavable sites, which can be located within the sequence of the linker or flanking the linker at either end of the linker sequence.

Linkers can be introduced into polypeptide sequences, such as any ADA2 provided herein, using techniques known in the art (e.g., chemical conjugation, recombinant techniques, or peptide synthesis). Modifications can be confirmed by DNA sequence analysis. In some examples, the linkers can be introduced using recombinant techniques. In other examples, the linkers can be introduced using solid phase peptide synthesis. In other examples, the polypeptide, such as any ADA2 provided herein, can contain simultaneously one or more linkers that have been introduced using recombinant techniques and one or more linkers that have been introduced using solid phase peptide synthesis or methods of chemical conjugation known in the art.

i. Peptide Linkers

Peptide linkers can be used to link the heterologous moiety to the ADA2 polypeptide provided herein. In one example, peptide linkers can be fused to the C-terminal end of a first polypeptide (e.g., the ADA2 polypeptide) and the N-terminal end of a second polypeptide (e.g., a protein or polypeptide heterologous moiety). This structure can be repeated multiple times such that at least one, preferably 2, 3, 4, or more polypeptides are linked to one another via peptide linkers at their respective termini.

For example, two molecules (e.g., the ADA2 polypeptide and the heterologous moiety) can be adjacent in the construct or separated by a linker polypeptide that contains, 1, 2, 3, or more, amino acids. In some examples, the peptide linker can contain at least two amino acids, at least three, at least four, at least five, at least 10, at least 20, at least 30, at least 40, at least 50, at least 60, at least 70, at least 80, at least 90, or at least 100 amino acids. In other examples, the peptide linker can contain at least 200, at least 300, at least 400, at least 500, at least 600, at least 700, at least 800, at least 900, or at least 1,000 amino acids. In some examples, the peptide linker can contain at least about 10, 20, 30, 40, 50, 60, 70, 80, 90, 100, 150, 200, 300, 400, 500, 600, 700, 800, 900, 1000, 1100, 1200, 1300, 1400, 1500, 1600, 1700, 1800, 1900, or 2000 amino acids. The peptide linker can contain 1-5 amino acids, 1-10 amino acids, 1-20 amino acids, 10-50 amino acids, 50-100 amino acids, 100-200 amino acids, 200-300 amino acids, 300-400 amino acids, 400-500 amino acids, 500-600 amino acids, 600-700 amino acids, 700-800 amino acids, 800-900 amino acids, or 900-1000 amino acids. The linker is of a length such that the two variable domains are bridged without substantial interference. For example, a linker polypeptide can have a sequence $Z_1—X—Z_2$, where $Z_1$ and $Z_2$ are the ADA2 polypeptide and the heterologous moiety, respectively, and where X is a sequence of a peptide linker. In another example, the polypeptide has a sequence of $Z_1—X—Z_2(—X—Z)_n$, where "n" is any integer, i.e. generally 1 or 2.

Typically, the peptide linker is of a sufficient length to allow both the ADA2 polypeptide and the heterologous moiety to retain their conformational structure and functions. Examples of peptide linkers include, but are not limited to: -Gly-Gly-, GGGG (SEQ ID NO:362), GGGGG (SEQ ID NO:360), GGGGS or (GGGGS)n (SEQ ID NO:343), SSSSG or (SSSSG)n (SEQ ID NO:344), GKSSGSGSESKS (SEQ ID NO:345), GGSTSGS-GKSSEGKG (SEQ ID NO:346), GSTSGS-GKSSSEGSGSTKG (SEQ ID NO:347), GSTSGSGKPGS-GEGSTKG (SEQ ID NO:348), EGKSSGSGSESKEF (SEQ ID NO:349), AlaAlaProAla or (AlaAlaProAla)n (SEQ ID NO:350), SGGSGGS (SEQ ID NO:363), GGSGGSGGSGGSGGG (SEQ ID NO:364), GGSGGSGGGGSGGGS (SEQ ID NO:365), GGSGGSGGSGGSGGSGGS (SEQ ID NO:366), GGGGSGGGGSGGGGS (SEQ ID NO:367), Ser(Gly$_4$Ser)$_n$ (SEQ ID NO:595) or (Gly-Ser)$_n$ residues with some Glu or Lys residues dispersed throughout to increase solubility, where n can be an integer from 1 to 20, such as 1, 2, 3, 4, 5, 6, 7, 8, 9, 10, 11, 12, 13, 14, 15, 16, 17, 18, 19, or 20. Other exemplary linkers include peptide linkers with the formula [(Gly)$_x$-Ser$_y$]$_z$ where x is from 1 to 4, y is 0 or 1, and z is from 1 to 50. In other examples, the peptide linker includes the sequence $G_n$, where n can be an integer from 1 to 100. In another example, the sequence of the peptide linker can be $(GA)_n$ or $(GGS)_n$. Other exemplary linkers include:

(1) Gly$_4$Ser with NcoI ends (SEQ ID NO:351)
CCATGGGCGG CGGCGGCTCT GCCATGG (2) (Gly$_4$Ser)$_2$ with NcoI ends (SEQ ID NO:352)
CCATGGGCGG CGGCGGCTCT GGCGGCGGCG GCTCTGCCAT GG (3) (Ser$_4$Gly)$_4$ with NcoI ends (SEQ ID NO:353)
CCATGGCCTC GTCGTCGTCG GGCTCGTCGT CGTCGGGCTC GTCGTCGTCG GGCTCGTCGT CGTCGGGCGC CATGG (4) (Ser$_4$Gly)$_2$ with NcoI ends (SEQ ID NO:354)
CCATGGCCTC GTCGTCGTCG GGCTCGTCGT CGTCGGGCGC CATGG Linking moieties are described, for example, in Huston et al. (1988) *PNAS* 85:5879-5883, Whitlow et al. (1993) *Protein Engineering* 6:989-995, and Newton et al., (1996) *Biochemistry* 35:545-553. Other suitable peptide linkers include any of those described in U.S. Pat. No. 4,751,180 or 4,935,233, which are hereby incorporated by reference. A polynucleotide encoding a desired peptide linker can be inserted between, and in the same reading frame as a polynucleotide encoding any ADA2 provided herein and the protein or polypeptide heterologous moiety, using any suitable conventional technique. Linking moieties can also include derivatives and analogs of the naturally occurring amino acids, as well as various non-naturally occurring amino acids (D- or L-), hydrophobic or non-hydrophobic, known in the art.

In some examples, a peptide linker includes peptides (or polypeptides) (e.g., natural, or non-naturally occurring peptides) which includes an amino acid sequence that links or genetically fuses a first linear sequence of amino acids to a second linear sequence of amino acids to which it is not naturally linked or genetically fused in nature. For example, the peptide linker can include non-naturally occurring polypeptides which are modified forms of naturally occurring polypeptides (e.g., that includes a mutation such as an addition, substitution or deletion). In another example, the peptide linker can include non-naturally occurring amino acids. In another example, the peptide linker can include naturally occurring amino acids occurring in a linear sequence that does not occur in nature. In still another example, the peptide linker can include a naturally occurring polypeptide sequence.

ii. Heterobifunctional Linking Agents

Linkage of any ADA2 provided herein and a heterologous moiety can be direct or indirect. For example, the linkage can be achieved by chemical linkage or facilitated by bifunctional or heterobifunctional linkers, such as any known in the art or provided herein.

Numerous heterobifunctional cross-linking reagents that are used to form covalent bonds between amino groups and thiol groups and to introduce thiol groups into proteins, are known to those of skill in the art (see, e.g., the PIERCE CATALOG, *ImmunoTechnology Catalog & Handbook*, 1992-1993, which describes the preparation of and use of such reagents and provides a commercial source for such reagents; see, also, e.g., Cumber et al. (1992) *Bioconjugate Chem.* 3:397-401; Thorpe et al. (1987) *Cancer Res.* 47:5924-5931; Gordon et al. (1987) *Proc. Natl. Acad Sci.* 84:308-312; Walden et al. (1986) *J. Mol. Cell Immunol.* 2:191-197; Carlsson et al. (1978) *Biochem. J.* 173: 723-737; Mahan et al. (1987) *Anal. Biochem.* 162:163-170; Wawrzynczak et al. (1992) *Br J. Cancer* 66:361-366; Fattom et al. (1992) *Infection & Immun.* 60:584-589). These reagents can be used to form covalent bonds between the N-terminal portion of the heterologous moiety and the C-terminal portion of the ADA2 provided herein, or between each of those portions and a linker. These reagents include, but are not limited to: N-succinimidyl-3-(2-pyridyldithio)propionate (SPDP; disulfide linker); sulfosuccinimidyl 6-[3-(2-pyridyldithio)proponamido]hexanoate (sulfo-LC-SPDP); succinimidyloxycarbonyl-α-methyl benzyl thiosulfate (SMBT, hindered disulfate linker); succinimidyl 6-[3-(2-pyridyldithio) propionamido]hexanoate (LC-SPDP); sulfo-succinimidyl 4-(N-maleimidomethyl)cyclohexane-1-carboxylate (sulfo-SMCC); succinimidyl 3-(2-pyridyldithio)butyrate (SPDB; hindered disulfide bond linker); sulfosuccinimidyl 2-(7-azido-4-methylcoumarin-3-acetamide) ethyl-1,3'-dithiopropionate (SAED); sulfo-succinimidyl 7-azido-4-methylcoumarin-3-acetate (SAMCA); sulfo-succinimidyl-6-[alpha-methyl-alpha-(2-pyridyldithio) toluamido]-hexanoate (sulfo-LC-SMPT); 1,4-di-[3'-(2'-pyridyldithio)propionamido]butane (DPDPB); 4-succinimidyloxycarbonyl-α-methyl-α-(2-pyridylthio) toluene (SMPT, hindered disulfate linker); sulfosuccinimidyl-6-[α-methyl-α-(2-pyrimiyldi-thio)toluamido]hexanoate (sulfo-LC-SMPT); m-maleimidobenzoyl-N-hydroxysuccinimide ester (MBS); m-maleimidobenzoyl-N-hydroxysulfo-succinimide ester (sulfo-MBS); N-succinimidyl(4-iodoacetyl)aminobenzoate (SIAB; thioether linker); sulfosuccinimidyl-(4-iodoacetyl)amino benzoate (sulfo-SIAB); succinimidyl-4-(p-maleimidophenyl)butyrate (SMPB); sulfosuccinimidyl-4-(p-maleimido-phenyl) butyrate (sulfo-SMPB); azidobenzoyl hydrazide (ABH); maleimido caproyl (MC); maleimido propanoyl (MP); succinimidyl 4-(K-maleimidomethyl)-cyclohexane-1-carboxylate (SMCC); m-maleimidobenzoyl-N-hydroxysuccinimide ester (MBS); N-succinimidyl(4-iodoacetyl)aminobenzonate (SIAB); and succinimidyl 6-[3-(2-pyridyldithio)-propionamide hexanoate (LC-SPDP) (see, e.g., U.S. Pat. No. 7,375,078). Other exemplary linkers include, but are not limited to linkers with the formula:

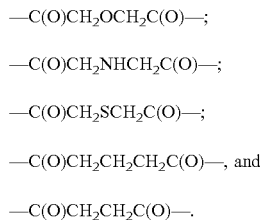

These linkers, for example, can be used in combination with peptide linkers, such as those that increase flexibility or solubility or that provide for or eliminate steric hindrance. Any other linkers known to those of skill in the art for linking a polypeptide molecule to another molecule can be employed. General properties are such that the resulting molecule retains the adenosine deaminase function and stability of the protein. For in vivo use of the ADA2 conjugate or fusion protein, generally the linker must be biocompatible for administration to animals, including humans.

E. METHODS OF PRODUCING NUCLEIC ACIDS ENCODING ADA2 AND POLYPEPTIDES THEREOF

Polypeptides of any ADA2 as described herein, including variants or modified forms thereof, can be obtained by methods well known in the art for protein purification and recombinant protein expression. Polypeptides also can be synthesized chemically. Modified or variant forms can be engineered from a wildtype polypeptide using standard recombinant DNA methods. For example, any ADA2, including variants or modified forms can be engineered from a wildtype polypeptide, such as by site-directed mutagenesis.

1. Isolation or Preparation of Nucleic Acids Encoding ADA2 Polypeptides

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening. For example, when the polypeptides are produced by recombinant means, any method known to those of skill in the art for identification of nucleic acids that encode desired genes can be used. Any method available in the art can be used to obtain a full length or partial (i.e., encompassing the entire coding region) cDNA or genomic DNA clone encoding the ADA2 polypeptide, such as from a cell or tissue source.

Methods for amplification of nucleic acids can be used to isolate nucleic acid molecules encoding a desired polypeptide, including for example, polymerase chain reaction (PCR) methods. Examples of such methods include use of a Perkin-Elmer Cetus thermal cycler and Taq polymerase (Gene Amp, Applied Biosystems, Carlsbad, Calif.). A nucleic acid containing material can be used as a starting material from which a desired polypeptide-encoding nucleic acid molecule can be isolated. For example, DNA and mRNA preparations, cell extracts, tissue extracts, fluid samples (e.g., blood, serum, saliva), samples from healthy and/or diseased subjects can be used in amplification methods. The source can be from any eukaryotic species including, but not limited to, vertebrate, mammalian, human, porcine, bovine, feline, avian, equine, canine, and other primate sources. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. If desired, degenerate primers can be used for amplification. Oligonucleotide primers that hybridize to sequences at the 3' and 5' termini of the desired sequence can be uses as primers to amplify by PCR sequences from a nucleic acid sample. Primers can be used to amplify the full-length ADA2. Nucleic acid molecules generated by amplification can be sequenced and confirmed to encode a desired polypeptide.

In addition, nucleic acid molecules encoding the ADA2 polypeptide can be chemically synthesized or produced in a semi-synthetic manner. The synthetically or semi-synthetically produced nucleic acid molecule can encode the amino acid sequence of any ADA2, such as any described herein in Section C above. For example, the synthesized or semi-synthetically produced nucleic acid molecule can be encoded by a nucleic acid molecule having a sequence of nucleotides of any as described herein. Chemically synthesized nucleic acid molecules can span the entire length of the wildtype ADA2 gene, or a truncated sequence thereof. Chemical gene synthesis can be achieved by any methods known in the art, such as annealing chemically synthesized oligonucleotides. Semi-synthetic gene assembly, such as the Gibson assembly method, can also be used to produce the nucleic acid molecule encoding any of the ADA2 polypeptides, including variants, as described herein.

The nucleic acid encoding any of the ADA2 polypeptides can be a codon-optimized nucleic acid molecule, where the codon is optimized for the expression system used to produce the polypeptide (i.e., codons that are preferred in the organism of the expression system are used more frequently in the synthesized nucleic acid). For example, for production of the polypeptide in an *Escherichia coli* expression system, the codons for each amino acid can be optimized such that the most preferred codon in *E. coli* are used for each amino acid.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residue sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene.

In addition, tags or other moieties can be added, for example, to aid in detection or affinity purification of the polypeptide. For example, additional nucleotide residue sequences such as sequences of bases specifying an epitope tag or other detectable marker also can be linked to enzyme-encoding nucleic acid molecules. Examples of such sequences include nucleic acid sequences encoding the FLAG® tag or the Strep tag.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pCMV-Script (Agilent Technologies, Santa Clara, Calif.), pBR322, pUC plasmid derivatives or pBluescript vectors (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.).

If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing.

Recombinant molecules can be introduced into host cells via, for example, transformation, transfection, infection, electroporation and sonoporation, so that many copies of the gene sequence are generated. In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

In addition to recombinant production, any ADA2, including variants or modified forms thereof provided herein can be produced by direct peptide synthesis using solid-phase techniques (see e.g., Stewart et al. (1969) *Solid-Phase Peptide Synthesis*, WH Freeman Co., San Francisco; Merrifield J (1963) *J Am Chem Soc.,* 85:2149-2154). In vitro protein synthesis can be performed using manual techniques or by automation. Automated synthesis can be achieved, for example, using Applied Biosystems 431A Peptide Synthesizer (Perkin Elmer, Foster City Calif.) in accordance with the instructions provided by the manufacturer. Various fragments of a polypeptide can be chemically synthesized separately and combined using chemical methods.

2. Generation of Mutant or Modified Nucleic Acid and Encoding Polypeptides

The modifications provided herein can be made by standard recombinant DNA techniques such as are routine to one of skill in the art. Any method known in the art to effect mutation of any one or more amino acids in a target protein can be employed. Methods include standard site-directed mutagenesis (using e.g., a kit, such as QuikChange available from Stratagene) of encoding nucleic acid molecules, or by solid phase polypeptide synthesis methods. Site-specific variations to the wildtype ADA2 or any of the ADA2 variants provided herein can also be introduced during the chemical gene synthesis or the semi-synthetic gene assembly if such methods are used to generate the nucleic acid sequence encoding the ADA2.

3. Vectors and Cells

For recombinant expression of one or more of the desired proteins, such as any ADA2 polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes any ADA2 polypeptide or variants, coupled to the native or heterologous signal sequence, as well as multiple copies thereof. The vectors can be selected for expression of the enzyme protein in the cell or such that the enzyme protein is expressed as a secreted protein.

Any of the variety of host-vector systems well known to those of skill in the art can be used to express the protein coding sequence. These include but are not limited to mammalian cell systems infected with virus (e.g., vaccinia virus, adenovirus and other viruses); insect cell systems infected with virus (e.g., baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, Nature 290:304-310 (1981)), the promoter contained in the 3' long terminal repeat of Rous sarcoma virus (Yamamoto et al., Cell 22:787-797 (1980)), the herpes thymidine kinase promoter (Wagner et al., Proc. Natl. Acad. Sci. USA 78:1441-1445 (1981)), the regulatory sequences of the metallothionein gene (Brinster et al., Nature 296:39-42 (1982)); prokaryotic expression vectors such as the β-lactamase promoter (Jay et al., Proc. Natl. Acad. Sci. USA 78:5543 (1981)) or the tac promoter (DeBoer et al., Proc. Natl. Acad. Sci. USA 80:21-25 (1983); see also "Useful Proteins from Recombinant Bacteria": in Scientific American 242:74-94 (1980)); plant expression vectors containing the nopaline synthetase promoter (Herrera-Estrella et al., Nature 303:209-213 (1984)) or the cauliflower mosaic virus 35S RNA promoter (Gardner et al., Nucleic Acids Res. 9:2871 (1981)), and the promoter of the photosynthetic enzyme ribulose bisphosphate carboxylase (Herrera-Estrella et al., Nature 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., Cell 38:639-646 (1984); Ornitz et al., Cold Spring Harbor Symp. Quant. Biol. 50:399-409 (1986); MacDonald, Hepatology 7: 425-515 (1987)); insulin gene control region which is active in pancreatic beta cells (Hanahan et al., Nature 315:115-122 (1985)), immunoglobulin gene control region which is active in lymphoid cells (Grosschedl et al., Cell 38:647-658 (1984); Adams et al., Nature 318:533-538 (1985); Alexander et al., Mol. Cell Biol. 7:1436-1444 (1987)), mouse mammary tumor virus control region which is active in testicular, breast, lymphoid and mast cells (Leder et al., Cell 45:485-495 (1986)), albumin gene control region which is active in liver (Pinkert et al., Genes and Devel. 1:268-276 (1987)), alpha-fetoprotein gene control region which is active in liver (Krumlauf et al., Mol. Cell. Biol. 5:1639-1648 (1985); Hammer et al., Science 235:53-58 (1987)), alpha-1 antitrypsin gene control region which is active in liver (Kelsey et al., Genes and Devel. 1:161-171 (1987)), beta globin gene control region which is active in myeloid cells (Magram et al., Nature 315:338-340 (1985); Kollias et al., Cell 46:89-94 (1986)), myelin basic protein gene control region which is active in oligodendrocyte cells of the brain (Readhead et al., Cell 48:703-712 (1987)), myosin light chain-2 gene control region which is active in skeletal muscle (Shani, Nature 314:283-286 (1985)), and gonadotrophic releasing hormone gene control region which is active in gonadotrophs of the hypothalamus (Mason et al., Science 234:1372-1378 (1986)).

In a specific example, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of E. coli cells, include, for example, the pQE expression vectors (available from Qiagen, Valencia, Calif.). pQE vectors enable placement of a 6×His tag at either the N- or C-terminus of the recombinant protein. Such plasmids include pQE32, pQE30, and pQE31 which provide multiple cloning sites for all three reading frames and provide for the expression of N-terminally 6×His tagged proteins. (need to fill I w/pCMV stuff). Other exemplary plasmid vectors for transformation of E. coli cells include, for example, pD444-SR (DNA2.0, Menlo Park, Calif.), which contains an Isopropyl β-D-1-thiogalactopyranoside (IPTG) inducible T5 promoter, a strong ribosome bind site (RBS) and a pUC derived origin of replication. Other exemplary plasmid vectors for transformation of E. coli cells, include, for example, the pET expression vectors (see, U.S. Pat. No. 4,952,496; available from Novagen, Madison, Wis.; see, also literature published by Novagen describing the system). Such plasmids include pET11a, which contains the T7lac promoter, T7 terminator, the inducible E. coli lac operator, and the lac repressor gene; pET12a-c, which contains the T7 promoter, T7 terminator, and the E. coli ompT secretion signal; and pET15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the pCMV-Script expression vector (Agilent Technologies, Santa Clara, Calif.; Cat. No. 212220). The pCMV-Script vector is derived from a high-copy-number pUC-based plasmid, and contains the human cytomegalovirus (CMV) immediate early promoter for constitutive expression of cloned inserts in a wide variety of cell lines. The vector contains DNA encoding the β-lactamase promoter and the SV40 early promoter linked to the neomycin/kanamycin resistance gene (neo/kan), an f1 origin of replication, a (CMV) immediate early promoter, an SV40 late polyadenylation signal (SV40), and the herpes simplex virus (HSV)-thymidine kinase (TK) polyA signal. Another example of a mammalian expression vector is the HZ24 expression vector, derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

Any of the ADA2 variants provided herein also can be encoded in expression vectors for in vivo expression, particularly tumor targeted or oncolytic vectors for expression in tumor cells. Vectors for in vivo expression include oncolytic vectors for delivery to tumors and expression therein or targeted for delivery to other cells and tissues, or gene therapy vectors. Oncolytic vectors for delivery include viral vectors for Newcastle Disease virus, parvovirus, vaccinia virus, reovirus, measles virus, vesticular stomatitis virus (VSV), oncolytic adenoviruses and herpes viruses. Oncolytic viral vectors for targeted delivery are well known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos. 2011/0177032, 2011/0158948, 2010/0092515, 2009/0274728, 2009/0285860, 2009/0215147, 2009/0010889, 2007/0110720, 2006/0039894 and 20040009604; retroviruses, see, e.g., U.S. Pat. Nos. 6,689,871, 6,635,472, 6,639,139, 5,851,529, 5,716,826, 5,716,613 and U.S. Pat. Pub. No. 20110212530; and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670. The vectors can be introduced into cells for cell therapy, such as immune cells for immunotherapy as described herein.

The vectors for targeted delivery of any of the ADA2 variants provided herein can also encode additional agents, such as agents for combination therapies that are proteins or polypeptides, for example, other immunomodulatory agents, chemotherapeutic agents, immune checkpoint inhibitors or hyaluronan-degrading enzyme, such as a soluble hyaluronidase or polymer-conjugated soluble hyaluronidase (e.g. PEGPH20). For example, in addition to any of the ADA2 variants provided herein, hyaluronan degrading enzymes can be encoded in expression vectors for in vivo expression, particularly tumor targeted or oncolytic vectors for expression in tumor cells (see, e.g., U.S. Pat. No. 8,450,470, and U.S. Patent Pub. No. 2011/0152359; see also U.S. Patent Pub. No. 2012/0148535).

Immune Cells that Encode and Express the ADA2 Variants Provided Herein

Any of the modified adenosine deaminase 2 (ADA2) variants provided herein can be employed in methods of adoptive immunotherapy. Methods for adoptive immunotherapy using immune cells modified to express a therapeutic protein or other protein, and optionally other proteins and receptors that increase immune response to overcome the immunosuppressive effect of cancers and/or to target the immune cells to specific cells are well known to those of skill in the art. Accordingly, provided are immune cells that encode one or more of the ADA2 variants provided herein, and optionally additional molecules to enhance tumor targeting and immune responses, particularly to overcome the immunosuppressive effect of certain tumors. The immune cells include, but are not limited to, tumor-infiltrating lymphocytes (TIL), cytotoxic T lymphocytes (CTL), natural killer (NK) cells, lymphokine-activated killer (LAK) cells, and immune cells, such as T-cells, that express chimeric antigen receptor (CAR).

Methods for immunotherapy by administration of immune cells are well known. Immune cells, which can be autologous or heterologous, but typically are autologous cells harvested from the subject to be treated, modified to express nucleic acid encoding any one or more of the ADA2 variants provided herein, and treated to remove tumor cells as needed, and expanded, if necessary. Nucleic acid can be introduced, for example, in an expression vector or in a vector or artificial chromosome that results in incorporation of the DNA encoding the ADA2 variant(s) into a chromosome or chromosomes of the immune cells. The immune cells are cultured, expanded and introduced into a subject having a tumor for treatment. In some embodiments, the immune cells are targeted to tumor cells. For example, in some embodiments, the cells encode an ADA2 variant and also express a chimeric antigen receptor (CAR). Cells containing CARS targeted to particular tumor antigens and methods for preparing such cells are known to those of skill in the art (see, e.g., International PCT Pub. No. WO 2014/186469).

CARs are well known, see e.g., any of International PCT Pub. Nos. WO 2012/031744, WO 2012/079000, WO 2013/059593, WO 2015/112626, WO 2014/011988 and U.S. Pat. No. 8,465,743, which describe CARs and cells expressing them and the uses thereof and improvements thereof; see also U.S. Patent Pub. No. US 20150064154, which describes cells and expression systems for producing immune cells that target tumors for use in cell therapy. The cell can be transfected, transduced or otherwise modified to express these heterologous proteins using standard methods known to those of skill in the art. The CAR can be engineered to target any tumor cell antigen of interest, including, but not limited to, HER2, CD19, HERV-K, CD20, CD22, ROR1, mesothelin, CD33/IL3Ra, c-Met, PSMA, Glycolipid F77, EGFRvIII, GD-2, NY-ESO-1 TCR, MAGE A3 TCR and GD2 and combinations thereof. Exemplary tumor antigens recognized by CARs are known to those of skill in the art (see, e.g., Renkvist et al. Cancer Immunol Immunother. 50(1):3-15 (2001) and Novelino et al. Cancer Immunol Immunother. 54(3):187-207 (2005)). The antigen binding region can include, for example, a fragment of the VH and VL chains of a single-chain variable fragment (scFv) derived from a particular human monoclonal antibody specific for a tumor cell antigen or can include a plurality of antigen binding domains of a human antigen-specific antibody. The scFv, for example can be linked to a flexible transmembrane domain followed by a tyrosine-based activation motif (see, e.g., Sadelain et al. Curr. Opin. Immunol. 21, 215-223 (2009)). CARS can include additional activation domains from co-stimulatory molecules such as CD28 and CD137 to enhance T cell survival and proliferation. The CARs and/or cells expressing them can further encode and express a costimulatory signaling regions that include, for example, intracellular domain of a costimulatory molecule, such as the intracellular domain of CD27, CD28, 4-1BB, OX40, CD30, CD40, PD-1, lymphocyte function-associated antigen-1 (LFA-1), CD2, CD7, LIGHT, NKG2C, B7-H3, a ligand that specifically binds with CD83, and any combination thereof.

A variety of CAR constructs and expression vectors for the same are known in the art. The expression vector can be one that remains episomal, or one that results in incorporation of nucleic acid encoding the CAR and/or the ADA2 variant into a chromosome, such as by homologous integration or by inclusion of transposon sequences, such that the presence of a transposase allows the coding sequence to integrate into a chromosome of a transfected cell. The nucleic acid encoding the ADA2 variant and CAR can be incorporated into the same vector or can be introduced in separate vectors. If transposon(s) are used, the cells can express a transposase that facilitates integration of the nucleic acid encoding the CAR and/or ADA2 variant into a chromosome of the transfected cells. Transposon systems are known (see, e.g., International PCT Pub. No. WO 2014/186469). The transposase can be provided in a DNA expression vector or as an expressible RNA or a protein for transient expression. Transposon systems are known to those of skill in the art such that long-term expression of the transposase does not occur in the transgenic cells. Any transposase system can be used in accordance with the embodiments. In other aspects, cells can be infected with a lentivirus to facilitate integration of the CAR coding sequence and the nucleic acid sequence that encodes the ADA2 variant into the genome of the cell.

4. Expression

Any adenosine deaminase 2 (ADA2) polypeptides including variant ADA2 polypeptides, can be produced by any method known to those of skill in the art including in vivo and in vitro methods. Desired proteins can be expressed in any organism suitable to produce the required amounts and forms of the proteins, such as for example, the amounts and forms needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification. Any of the ADA2 variants provided herein also can be encoded in expression vectors for in vivo expression, particularly tumor targeted or oncolytic vectors for expression in tumor cells.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

The ADA2 polypeptides, including variant ADA2 polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g., a His$_6$ tag or a FLAG™ tag, or a tag for purification, for example, a GST fusion, and a sequence for directing protein secretion and/or membrane association.

a. Prokaryotic Cells

Prokaryotes, especially *Escherichia coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as any ADA2 polypeptides or variants. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and

*Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including any ADA2 polypeptides, including variant ADA2 polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-$\zeta$ and Fc$_\epsilon$RI-$\gamma$ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitate purification of secreted proteins from the cell culture media. Examples include CHO-S cells (Invitrogen, Carlsbad, Calif., cat #11619-012) and the serum free EBNA-1 cell line (Pham et al., (2003) *Biotechnol. Bioeng.* 84:332-342). Cell lines also are available that are adapted to grow in special media optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce any ADA2 polypeptides. Because plants have different glycosylation patterns than mammalian cells, this can influence the choice of protein produced in these hosts.

5. Purification Techniques

Method for purification of polypeptides, including any ADA2 polypeptides, including variant ADA2 polypeptides, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as ADA2 polypeptides, can be purified using standard protein purification techniques known in the art including but not limited to, SDS-PAGE, size fraction and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind ADA2 enzymes can be used in affinity purification. Expression constructs also can be engineered to add an affinity tag to a protein such as a FLAG™ epitope, GST fusion or His$_6$ and affinity purified with an anti-FLAG™ antibody, glutathione resin and Ni-resin, respectively.

When proteins are expressed by transformed bacteria in large amounts, typically after promoter induction, although expression can be constitutive, the polypeptides can form insoluble aggregates. There are several protocols that are suitable for purification of polypeptide inclusion bodies known to one of skill in the art. Numerous variations will be apparent to those of skill in the art. For example, in one method, the cell suspension is generally centrifuged and the pellet containing the inclusion bodies resuspended in buffer which does not dissolve but washes the inclusion bodies, e.g., 20 mM Tris-HCl (pH 7.2), 1 mM EDTA, 150 mM NaCl and 2% Triton-X 100, a non-ionic detergent. It can be necessary to repeat the wash step to remove as much cellular debris as possible. The remaining pellet of inclusion bodies can be resuspended in an appropriate buffer (e.g., 20 mM sodium phosphate, pH 6.8, 150 mM NaCl). Other appropriate buffers are apparent to those of skill in the art.

Alternatively, proteins can be purified from bacteria periplasm. Where the protein is exported into the periplasm of the bacteria, the periplasmic fraction of the bacteria can be isolated by cold osmotic shock in addition to other methods known to those of skill in the art. For example, in one method, to isolate recombinant polypeptides from the periplasm, the bacterial cells are centrifuged to form a pellet. The pellet can be resuspended in a suitable buffer containing 20% sucrose. To lyse the cells, the bacteria can be centrifuged and the pellet resuspended in ice-cold 5 mM $MgSO_4$ and kept in an ice bath for approximately 10 minutes. The cell suspension is centrifuged and the supernatant decanted and saved. Recombinant proteins present in the supernatant can be separated from the host proteins by standard separation techniques well known to those of skill in the art, such as the separation techniques described herein. These methods include, but are not limited to, the following steps: solubility fractionation, size differential filtration, and column chromatography.

ADA2 protein molecules having a molecular weight of from or from about 95 kDa to 120 kDa, and generally from or from about 100 kDa to 110 kDa, inclusive, can be collected and purified. When in monomer form, or when assessed under reducing conditions on an SDS PAGE gel, the molecular weight of ADA2 is generally from or from about 50 kDa to 60 kDa, such as generally from or from about 57 kDa to 59 kDa. It is understood that variants or other modified forms can exhibit higher or lower molecular weights. For example, typically hyperglycosylated variants or conjugates as provided herein can exhibit higher molecular weights.

Purity can be assessed by any method known in the art including gel electrophoresis and staining and spectrophotometric techniques. Any ADA2 polypeptides, including variant ADA2 polypeptides, can be purified to 60%, 70%, 80% purity and typically at least 90%, 91%, 92%, 93%, 94%, 95%, 96%, 97%, 98% or 99% purity. Purity can be assessed by standard methods such as by SDS-PAGE and coomassie staining.

F. METHODS OF ASSESSING ACTIVITY AND PHYSICAL PROPERTIES OF ADA2

Assays can be used to assess the physical properties, stability and/or activity of any of the ADA2 protein molecules provided herein, including wildtype and variants and modified forms thereof. The properties and activities can be related to biological activities and/or tumor treatment activities. The assays can be performed in vitro or in vivo. For example, the assays can be used to assess the adenosine deaminase activity of the ADA2, heparin binding, thermal stability, pH optima, pharmacokinetics, tumor growth inhibitor activity and other activities and properties. In another example, the assays can be used to assess the effects of administering any ADA2 provided herein, including effects of dose and route of administration. The assays also can be used make minor adjustments to the formulations provided herein while retaining the activity of ADA2 for therapeutic use. Such assays are well known to a skilled artisan. Non-limiting exemplary assays are described in the following subsections.

1. Adenosine Deaminase Assay

The adenosine deaminase (ADA; EC 3.5.4.4) activity of any of the ADA2 described herein, including a wildtype, variant or conjugate, can be assessed using methods well known in the art. ADA activity assays commonly measure, directly or indirectly, the rate of production a product of the enzymatic reaction. For example, the production of inosine or ammonia can be directly or indirectly measured. In other examples, the decrease of the substrate of the enzyme, e.g., adenosine or 2-deoxyadenosine, is measured. The decrease of the substrate, or the increase of the product, can be measured directly by spectrophotometry, or indirectly, by subsequent enzymatic or oxidation-reduction reactions that use chromogenic substrates or change the absorbance spectra of the reaction.

For example, some commercially available adenosine deaminase (ADA) assays, such as ADA assay kits available from BQ Kits (San Diego, Calif.; Cat. No. BQ014EALD) and Diazyme (Poway, C A; Cat. No. DZ117A-K), utilize colorimetric substrate and spectrophotometric reading to determine the conversion of adenosine to inosine by ADA enzymes. In these assays, the production of inosine is detected by multi-step enzymatic reactions that produce a chromogenic dye. Enzymatic deamination of adenosine produces inosine, which is converted to hypoxanthine by the inosine-specific purine nucleoside phosphorylase (PNP; EC 2.4.2.1) present in the reaction. Hypoxanthine is then converted to uric acid and hydrogen peroxide ($H_2O_2$) by xanthine oxidase (XOD; EC 1.1.3.22). $H_2O_2$ is further reacted with N-Ethyl-N-(2-hydroxy-3-sulfopropyl)-3-methylaniline (EHSPT) and 4-aminoantipyrine (4-AA) in the presence of peroxidase (POD) to generate a quinone dye which is detectable in a kinetic manner using a UV spectrophotometer at 556 nm. Bovine liver adenosine deaminase can be used as standards. The change in absorbance at 556 nm ($\Delta A_{556}$) over time, at 37° C., is measured. One unit of ADA is defined as the amount of ADA that generates one µmole of inosine from adenosine per minute at 37° C. Adenosine deaminase activity in mU/mL is calculated using the following formula:

$$1 \text{ mU/mL} = (\Delta A_{556}/\text{min} \times T_v)/(S_v \times \epsilon \times 1)$$

where $T_v$=total volume of reaction; $S_v$=sample volume, $\epsilon$=32.2×10$^{-3}$ µM$^{-1}$ cm$^{-1}$, 1=0.5 cm.

ADA activity can be visualized using other colorimetric methods (see, e.g., Manchenko, G. P., Handbook of Detection of Enzymes on Electrophoretic Gels, CRC Press, pp. 453-454). For example, the $H_2O_2$ produced in the ADA assay described above, can be visualized by the addition of phenazine methosulfate (PMS), which is converted to dihydroPMS by $H_2O_2$, then the dihydroPMS converts nitroblue tetrazolium chloride (NBT) to formazan. Absorbance of formazan can be determined at 570 nm.

Another method to measure ADA activity is by measuring the release of ammonia from adenosine, when it is deaminated to form inosine. Ammonia release can be measured using commercially available kits, such as the Ammonia Assay kit (Cat. No. A0853, Sigma-Aldrich, St. Louis, Mo.). The kit contains dry reagents containing α-ketoglutaric acid and NADPH. Ammonia reacts with α-ketogluaric acid (KGA) and reduced nicotinamide adenine dinucleotide phosphate (NADPH) in the presence of L-glutamate dehydrogenase (GDH; Cat. No. G2294, Sigma-Aldrich). The decrease in absorbance at 340 nm, due to the oxidation of NADPH to NADP+, is proportional to the ammonia concentration, and hence the adenosine deaminase activity. The decrease in absorbance can be measured using a spectrophotometer. Adenosine deaminase activity in mU/mL (µM/min equivalent) is calculated using the following formula:

$$1\ mU/mL = (\Delta A/min \times T_v)/(S_v \times \epsilon \times 1)$$

where $T_v$=total volume, $S_v$=sample volume, $\epsilon$=6.22×10$^{-3}$ µM$^{-1}$ cm$^{-1}$, 1=1 cm.

Other spectrophotometry-based adenosine deaminase assays include the continuous optical assay, which directly measures the changes in adenosine absorbance. Absorbance of adenosine can be measured at 265 nm, and the decrease of absorbance at 265 nm, as adenosine is deaminated to inosine, is measured over time. The samples are prepared in a 100 mM potassium phosphate buffer, pH 7.5 at 25° C. containing 0.1% (w/v) bovine serum albumin (BSA), and is incubated with 1.35 mM adenosine solution, pH 7.0 at 25° C. The decrease in absorbance at 265 nm ($\Delta A_{265}$) is measured for approximately 5 minutes. In this assay, ADA activity in U/mL is calculated using the following formula:

$$\text{Units/mL enzyme} = (\Delta A_{265}/min)(T_v)(df))/(8.1)(V_E)$$

where $T_v$=Total volume (in mL) of assay; df=Dilution Factor; 8.1=Millimolar extinction coefficient of adenosine at 265 nm; $V_E$=Volume (in milliliters) of enzyme used.

One unit will deaminate 1.0 µmole of adenosine to inosine per minute at pH 7.5 at 25° C. Such method can be performed in a larger scale format such as in a 96-well microtiter plate format (see, for example, Lu et al. (2012) Clinica Chimica Acta 413:1637-1640).

A variation of this method can be used, with necessary corrections made to the absorbance measurements. UV absorption peak of adenosine and inosine are at 261 nm and 249 nm, respectively, and the spectra overlap significantly. During the deamination reaction, the absorbance of Adenosine decreases while that of inosine increases with time. To determine the relative adenosine, whose spectra overlap with that of inosine, two spectrophotometric measurements are made. The isobestic point, where adenosine and inosine have the same extinction coefficient and remains unchanged, is at 253 nm, and is concentration independent. The isobestic point is also measured as the reference point to correct for volume or intensity discrepancies. The ratio of absorbance at 261 nm/absorbance at 253 nm ($A_{261}/A_{253}$) is used to measure changes in adenosine concentration, based on a standard curve.

2. Methods of Assessing Heparin Binding

Heparin binding, or binding to another GAG; by any ADA2 described herein, including a wildtype, variant or conjugate, can be assessed using methods well known in the art. These methods and other methods known in the art to assess binding to GAGs, can be used to assess binding and/or select ADA2 variants with altered heparin binding, e.g. attenuated heparin binding or increased heparin binding. Generally, heparin-binding is sensitive to the presence of metal ions, urea, and detergents (anionic, nonionic, and zwitterionic). $Ca^{2+}$ and $Mg^{2+}$ and the zwitterionic detergent 3-[(3-cholamidopropyl)dimethylammonio]-1-propanesulfonate increases heparin binding. The presence of NaCl, urea, sodium dodecylsulfate, and $La^{3+}$ reduces heparin binding.

a. Affinity Assay

The ability of ADA2 to bind heparin can be assessed using affinity binding assays with immobilized heparin. Heparin is a highly sulfated glycosaminoglycan, and is widely used as a general affinity ligand. Its high degree of sulfation imparts a strong acidic nature to the molecule, therefore it binds many substances, including ADA2, by ionic interaction. In addition, heparin contains unique carbohydrate sequences, which act as specific binding sites for some proteins. Columns containing immobilized heparin are used to assess binding of and purify proteins with high affinity for heparin, such as DNA-binding proteins, coagulation factors, lipoproteins, and protein synthesis factors. For example, commercially available heparin resin columns, such as HiTrap Heparin HP loaded with heparin-Sepharose™ resin (GE Healthcare, Pittsburgh, Pa.; Cat. No. 17-0998-01), can be used to assess binding of a specific protein, such as ADA2. In the heparin-Sepharose™ resin, heparin is coupled to the Sepharose High Performance base matrix via the N-hydroxysuccinamide coupling method, to provide high capacity, performance, and low leakage levels.

Heparin binding can be assessed by an affinity assay using the heparin-Sepharose™ resin. In such an exemplary assay, 35 µL of ADA2, wildtype or variants, is mixed with 20 µL heparin-Sepharose™ resin (GE Healthcare, Pittsburgh, Pa.; Cat. No. 17-0998-01), followed by incubating at room temperature for 30 min. The mixture is then centrifuged through a 0.22 µm centrifuge filter and the flow-through, containing the unbound protein, is collected for analysis on an SDS-PAGE gel. 35 µL of 1.5 M NaCl is added to heparin-Sepharose resin and incubated at room temperature (RT) for 10 min to elute the remaining heparin-bound protein from the heparin-Sepharose. Degree of heparin binding is assessed by SDS-PAGE, by comparing the amount of ADA2, wildtype and variants, bound to the resins and the flowthrough to the amount in the input.

b. ELISA Assay

Heparin binding of a protein, such as any ADA2 provided herein, can also be assessed using enzyme-linked immunosorbant assay (ELISA) based methods. ELISA-based methods use heparin immobilized on a surface, such as a microtiter plate. The protein of interest which binds to heparin, such as any ADA2 provided herein, is incubated in the heparin coated plate, and binding is detected using antibodies that detect the protein of interest, such as any ADA2 provided herein.

For example, a 96-well plate coated with 100 µL of 200 µg/mL heparin sodium salt (Calibochem, EMD Milipore, Billerica, Mass.; Cat. No. 375095) in $Na_2CO_3$ buffer (pH 9.6) can be used to test ADA2 binding to heparin. After binding of ADA2, such as wildtype or variants or modified forms thereof, the wells are washed and incubated with a horseradish peroxidase (HRP)-conjugated detection antibody, e.g., HRP-anti-FLAG antibody (Abcam, Cambridge, UK; Cat. No. Ab1238) to detect the FLAG tag on the protein of interest, such as any ADA2 provided herein. After incubation and washing, the degree of binding of the protein of interest to the immobilized heparin on the plate is visualized by a chromogenic substrate, such as 3,3',5,5'-Tetramethylbenzidine (TMB) substrate solution (Pierce, Thermo Fisher Scientific, Rockford, Ill.) for HRP, is added for color development. The optical density (OD) of each reaction is measured on a plate reader.

In another example, heparin is immobilized by incubating Streptavidin-coated microtiter plates, such as the Streptavidin-coated 96-well plate (Thermo Fisher Scientific, Rockford, Ill.; Cat. No. 15520), with biotinylated heparin, such as biotin-heparin (Sigma-Aldrich, St. Louis, Mo.; Cat No. B9806-10MG). After binding of ADA2, wildtype or variants or modified forms thereof, the wells are washed and incubated with a horseradish peroxidase (HRP)-conjugated detection antibody, e.g., HRP-anti-FLAG antibody (Abcam, Cambridge, UK; Cat. No. Ab1238) to detect the FLAG tag on the protein of interest, such as any ADA2 provided herein. After incubation and washing, the degree of binding of the protein of interest to the immobilized heparin on the plate is visualized by a chromogenic substrate, such as 3,3',5,5'-Tetramethylbenzidine (TMB) substrate solution (Pierce, Thermo Fisher Scientific, Rockford, Ill.) for HRP, is added for color development. The optical density (OD) of each reaction is measured on a plate reader.

Any variations of these methods known in the art can also be used. For example, it is within the level of one of skill in the art to select a suitable solid support depending on the particular assay conditions, such as a particular pH condition. Nickel coated microplates can be less suitable for binding of His-tagged proteins, since buffer pH can affect antigen coating to Ni-coated but not high-bind plates. In addition, various methods can be used to immobilize heparin to the plate, such as conjugation with bovine serum albumin (BSA) or other carriers coating with protamine sulfate with an excess of heparin.

Buffers, blocking solutions and reaction conditions can also be selected based on the desired binding assay. For example, blocking solutions include those containing human, bovine, horse or other serum albumin or gelatin. Blocking of a solid support, such as a plate, can be performed using a binding assay buffer to which one or more blocking agents are added. Exemplary blocking agents include 1-5% Bovine Serum Albumin (BSA), 1-5% non-fat dry milk, 0.1-1% gelatin and 25% human serum. Detergents, such as Tween-20, and preservatives, such as thimerosal, can be added to the blocking solution. Binding assay buffers include i.e. the tumor microenvironment buffer or the normal physiologic buffer. The aqueous protein solution-solid support mixture is typically maintained for a time period of 30 minutes, 1 hour, or longer, and can vary as a function of the temperature. The blocking reaction can be performed at any temperature, and generally can be performed 4° C.–37° C., such as 4° C., room temperature (i.e., 22° C.) or 37° C. In some examples, the reaction is allowed to proceed for at least one hour at a temperature of about 4° C.–37° C. For example, blocking can be achieved at room temperature for one hour. After incubation and blocking, the resulting solid phase can be thereafter rinsed free of unbound protein prior to contact with the test molecule (e.g. ADA2 wildtype, variants and modified forms provided herein).

Examples of enzyme labels include horseradish peroxidase, alkaline phosphatase, and β-D-galactosidase. Examples of enzyme substrates that can be added to develop the signal include PNPP (p-Nitrophenyl Phosphate, Disodium Salt), ABTS (2,2'-Azinobis [3-ethylbenzothiazoline-6-sulfonic acid]-diammonium salt), OPD (o-phenylenediamine dihydrochloride), and TMB (3,3',5,5'-tetramethylbenzidine) (SOMA Labs, Romeo, Mich.), including Sureblue TMB Microwell Peroxidase Substrate 1-component (KPL, #52-00-03). The reaction can be stopped by adding a stopping reagent (e.g. TMB stop solution). The absorbance at a suitable wavelength (i.e. 450 nm) can be determined.

For fluorescence, a large number of fluorometers are available. For chemiluminescence detection, such as detection of horseradish peroxidase (HRP) substrates, luminometers or films are available. With enzymes, a fluorescent, chemiluminescent, or colored product can be determined or measured fluorometrically, luminometrically, spectrophotometrically or visually. For example, an anti-tag reagent can be conjugated to horseradish peroxidase (HRP) or other detectable agent.

Detection can be facilitated by the presence of a fluorescent, radioactive or other detectable moiety. For example, any ADA2 polypeptides provided herein, including wildtype and variant polypeptides and modified forms thereof, can harbor an N- or C-terminal tag, such as a FLAG tag, and can be detected using an anti-tag reagent, such as an anti-FLAG antibody. The choice of anti-tag reagent is a function of the tag that is employed with the binding molecule or protein. In addition, an anti-tag reagent is chosen that is compatible with the environment conditions (e.g. pH) used in the assay. It is within the level of one of skill in the art to identify or select such reagents, and test their compatibility with the assay conditions. Anti-tag reagents are readily available such as from commercial sources or other sources. Exemplary anti-tag reagents that can be used for detection in the methods herein include, but are not limited to an anti-FLAG antibody or anti-Myc antibody (available from vendors such as Abcam, Cambridge, Mass.; GeneTex, Irvine, Calif.). In addition, depending on the protein of interest and strength of signal, other antibodies and/or chromogenic substrates can be used in a variant version of the ELISA. For example, for native proteins that do not harbor a tag, detection can be achieved using two antibodies, e.g., primary antibody recognizing the native target and a secondary antibody conjugated with enzymes used for detection.

Typically, in the methods herein, the method of detection of the bound complex is one that is capable of being quantitated. For example, a label can produce a signal, such as a colorimetric signal, a chemiluminescent signal, a chemifluorescent signal or a radioactive signal. Depending upon the nature of the label, various techniques can be employed for detecting or detecting and quantitating the label. For example, methods of quantitation include, but are not limited to, spectrophotometric, fluorescent and radioactive methods.

c. Dot Blot and Other Radiolabeled Heparin Binding Assays

The degree of heparin binding can also be detected using blot-based methods with radiolabeled heparin. For example, a dot blot method can be used to detect and quantitate picomole amounts of heparin-binding protein of interest. Proteins are spotted on nitrocellulose and then incubated with $^{125}$I-heparin. Binding of heparin to the proteins is detected by radioautography and quantitated by scanning densitometry; proteins are quantitated by densitometric analysis of the amido black stained nitrocellulose (Hirose et al. (1986) Analytical Biochemistry 156(2):320-325). In another example, radiolabeled heparin, such as $^3$H-heparin is incubated in a 96-well microtiter format with the heparin binding protein of interest, such as any ADA2 provided herein, including wildtype, variants or modified forms thereof. The mixture is then transferred to a 96-well microtiter filter plates which filters out the unbound heparin and protein of interest. Binding is detected by scintillation counting (see Proudfoot et al. (2003). PNAS 100(4):1885-1890).

3. Methods for Assessing Stability

Stability of any of the ADA2 provided herein in specific conditions can be determined by any method known to one of skill in the art used to assess protein stability. Stability in a specific condition (e.g., high temperature condition for thermal stability, high or low pH conditions for pH tolerance, plasma conditions for plasma stability, and long-term storage for long-term stability) can be assessed by determining changes in physical properties of the polypeptide, including but not limited to, structural configuration or conformation, enzymatic activity, protein unfolding, aggregation, and solubility, before and after without exposure to the specific condition. Stability also can be assessed by comparing any one or more of activity, aggregation or other physical properties in the presence of one or more denaturation conditions compared to a native, wildtype or reference ADA2 polypeptide.

Protein stability includes a measure of the maintenance of one or more physical properties of a protein in response to an environmental condition (e.g. an elevated temperature). In one example, the physical property is the maintenance of the covalent structure of the protein (e.g. the absence of proteolytic cleavage, unwanted oxidation or deamidation). In another example, the physical property is the presence of the protein in a properly folded state (e.g. the absence of soluble or insoluble aggregates or precipitates). In one example, stability of a protein is measured by assaying a biophysical property of the protein, for example thermal stability, pH unfolding profile, stable removal of glycosylation, solubility, biochemical function (e.g., enzymatic activity, ability to bind to a protein (e.g., a ligand, a receptor, an antigen, etc.) or chemical moiety, etc.), and/or combinations thereof. In another example, biochemical function is demonstrated by the binding affinity of an interaction. In addition, stability can be assessed by visual inspection, percent recovery, protein purity and apparent melting temperature. Stability measurements also provide important biological information; a decrease in stability can be a sign of protein unfolding, misfolding and aggregation, which can lead to polypeptides ineffective for treatment. Such assays can be performed under any conditions that can result in protein instability, and can be assessed on any physical or functional properties associated with an ADA2 protein. Stability can be measured using any methods known in the art and/or described herein.

a. Conditions i. Stability in Plasma

For therapeutic uses, such as for treatment of tumors or cancers, it is desirable to administer to the subject a dosage of ADA2 that will maintain plasma adenosine deaminase (ADA) activity for a sufficient time for therapeutic effect. Hence, sufficient retention of stability in the plasma and tumor microenvironment (TME) is necessary for effectiveness of the treatment. The plasma stability of any ADA2 described herein, such as a wildtype, variant or conjugate, can be determined by measuring the changes in enzymatic activity and/or other physical properties, before and after incubation in plasma, e.g., ex vivo mammalian plasma.

Stability can be assessed in vitro or in vivo. For example, stability can be tested after exposure to plasma for a desired length of time, which can be empirically determined or selected by a skilled artisan depending on the desired length of time. For example, the incubation time can be at least 1 hour, such as at least 2, 3, 4, 5, 10, 15, 20, 24, 30, 36, 48, 60, 72 hours or more. The protein can be directly administered systemically, such as intravenously, and activity can be assessed. In other examples, the protein can be subject to appropriate incubation conditions in vitro. In one example, the stability of ADA activity of any ADA2 provided herein can be measured after incubation at 37° C., in 25% ex vivo plasma or serum, such as human or non-human plasma or serum, for example, mouse plasma. For example, as shown herein, ADA2 is more stable than ADA1 after a long incubation (e.g., 24 hours) in plasma. Other conditions, such as temperature, type of plasma and buffer conditions, can also be selected based on the desired conditions to be tested.

ii. Thermal Stability

Proteins differ in their degrees of thermal stability (or thermostability). In particular, proteins with biological activities, such as enzymes, can have different optimal temperatures. Thermostability, the quality of a protein to resist irreversible change in its chemical or physical structure at a relatively high temperature, can be indicative of overall stability of a protein. Increased temperature usually induces protein unfolding, and disruption of secondary, tertiary and quaternary structure of proteins, leading to destabilization of protein. Thermostability of a protein, such as any ADA2 polypeptide provided herein, can be determined by measuring the changes in enzymatic activity and/or other physical properties, before and after incubation in relatively high or low temperatures.

The stability of a protein can be determined by measuring the activity of the protein as a function of time. The melting temperature ($T_m$) of the protein can be used as a marker of solution stability and in vivo stability for proteins. The unfolding temperature of a particular protein refers to that temperature at which the protein loses its secondary structure and typically, its activity and can be determined using methods known to those of skill in the art and described herein, such as differential scanning calorimetry (DSM). In another example, other methods to determine the physical property of the protein, such as dynamic light scattering (DLS), can be used to characterize the stability of proteins as a function of temperature. In other examples, the thermal stability can be measured biochemically. An exemplary biochemical method for assessing thermal stability is a thermal challenge assay. In a "thermal challenge assay," a polypeptide is subjected to a range of elevated temperatures for a set period of time. For example, in one embodiment, test polypeptides are subject to a range of increasing temperatures, e.g., for 10 minutes. The activity of the protein is then assayed by a relevant biochemical assay (e.g., adenosine deaminase assay). The thermal challenge assay can be used to determine the temperature at which 50% adenosine deaminase (ADA) activity is retained (i.e., the $T_C$ value or $T_{50}$). The $T_C$ or $T_{50}$ values are not necessarily equivalent to the biophysically derived $T_m$ values. Such an assay can be performed to assess the thermal stability of any of the ADA2 provided herein, including wildtype, variants, conjugates and other modified forms thereof.

iii. Stability in pH or pH Optima

Proteins also differ in their ability to tolerate changes in pH, or can have different optimal pH for biological activity. Variations in pH in the environment can result in changes in the charge on the basic and acidic groups of amino acid side chains in a protein causing changes in electrostatic interactions that can destabilize the native structure. Relatively small changes in pH can result in fairly dramatic decreases in protein conformational stability, and the changes in conformational stability can also lead to aggregation of the proteins. The ionic strength in solution and the isoelectric point (pI) of the solution also contribute to the stability of the protein in solution in different pH conditions.

For example, the pH environment of the tumor, and the pH optima of a particular protein, can affect the therapeutic efficacy of an ADA2 protein. For example, the tumor microenvironment (TME) has regions, which generally are in hypoxic areas, with relatively acidic pH, such as pH 6.5-6.9 or lower. On the other hand, in regions with proliferating tissue, such as near blood vessels, the TME pH is more neutral. Thus, the pH optima of an ADA2 protein can be an important factor in determination of dosage and formulation of proteins used in methods of treating tumors as described herein.

The stability of a protein, such as any ADA2 polypeptide provided herein, in a specific pH environment, can be determined by measuring the changes in enzymatic activity and/or other physical properties, before and after incubation in relatively high or low pH. For example, the enzymatic activity of any of the ADA2 provided herein can be measured using an ADA activity assay described herein, at various pH conditions (e.g. at pH ranging from or from about 6.0 to 8.0, such as from or from about 6.5 to 7.5, inclusive, for example 6.5±0.2 or 7.4±0.2). In another example, other methods to determine the physical property of the protein, such as, dynamic light scattering (DLS), can be used to characterize the stability of proteins as a function of solution pH.

iv. Other Conditions

Other conditions in the environment or the formulation, such as ionic strength, buffer compositions, presence of other substances such as other proteins in the tumor microenvironment, presence of pharmaceutical excipients, or presence of other agents used for combination therapy, can contribute to the stability of the polypeptide used in the method of treatment, such as any of the ADA2 polypeptides provided herein. Stability of the polypeptide in conditions that are can affect protein stability and function can be tested using methods described below, but after incubation in the specific condition to be tested. The assays can be used make minor adjustments to the formulations provided herein while retaining the stability of ADA2 and/or other agents used in combination therapy.

b. Determination of Physical Properties

Stability of a polypeptide, such as any ADA2 polypeptide provided herein, can be determined by measuring changes in physical or functional properties or activities of the polypeptide, such as enzymatic activity, structural configuration or conformation, enzymatic activity, protein unfolding, aggregation, and solubility, using any methods known in the art. The functional or physical property that is assessed can be compared in the presence and absence of the condition (e.g. plasma, temperature, pH or other condition). It is understood that the assay to compare or assess the stability of the protein in the presence of a condition compared to its absence is substantially the same, except for the presence of or the extent of the condition present.

Proteins are stabilized by physical forces such as hydrogen bonds, hydrophobic interactions, electrostatic interactions, disulfide bonds, and van der Waals force. Disruption of any of these forces can destabilize the protein, and the disruption of these forces can be measured using a variety of methods known in the art. Also, in certain conditions, such as specific pH or temperature, or high protein concentration during overexpression, the polypeptide can form protein aggregates. Protein aggregates are the irreversibly assembled protein molecules to form higher-order oligomers with native or non-native protein structures that can be soluble or insoluble in nature. Aggregation often results in conformational destabilization of the protein.

Methods to determine changes in physical properties include spectroscopy, thermodynamic methods, hydrodynamic methods, chromatography, electrophoresis, analysis of biological activity, and analysis of protein-protein interaction (see, e.g., Uversky, V. and E. Permiakov, eds., Methods in Protein Structure and Stability Analysis, Nova Science Publishers, New York (2007); Chaudhury et al. (2014) The AAPS Journal 16(1):48-64). An increase in particle size and/or a decrease in the melting temperature also can indicate denaturation and subsequent aggregation of the ADA2 polypeptide. In addition, protein stability can be assessed by visual inspection of protein integrity by electrophoretic methods, calculating percent recovery, protein purity and apparent melting temperature. Exemplary assays to assess protein stability are described below.

i. Enzymatic Activity

Disruption of stability can cause changes in tertiary structure of the active site of an enzyme, leading to a disruption of enzymatic activity. Biological activity is often closely correlated with changes in other physical properties of the protein, such as circular dichroism spectra. Functional assays, such as enzymatic activity assays, including any of the adenosine deaminase (ADA) activity assays described above, can be used as a measure of protein stability in the presence and absence of an assessed condition. For example, the stability of adenosine deaminase (ADA) can be measured before and after exposure to specific conditions, e.g., conditions described above in Section F.2.a, to assess the stability of any ADA2 provided herein. Exposure to a specific condition, such as incubation in plasma, can be performed at a fixed time point, or assessed over several time points.

ii. Chromatographic Analysis of Protein Purity

Methods to assess the purity of the native protein can be used as a measure to determine the state of degradation or other destabilizing events for a protein. Protein purity can be measured using chromatographic methods, for example, by reversed phase high performance liquid chromatography (RP-HPLC). Protein purity, as determined by RP-HPLC, is the percent of the main ADA2 protein peak present, as compared to all of the protein species present. Thus, RP-HPLC, and similar methods known to one of skill in the art, can assess degradation of the enzyme. Protein purity can be assessed over time. Protein purity can be assessed in the presence of one or more conditions, such as conditions described above in Section F.2.a, and in varying amounts thereof. Percent recovery also can be determined as the relative percentage of the polypeptide in the presence of various conditions for different lengths of time as compared to a reference sample. The stability of any ADA2 polypeptides provided herein, including wildtype, variants, conjugates or other modified forms thereof, also can be determined by measuring the oxidation of the polypeptide by RP-HPLC. Percent oxidation is a measure of sum of the peak areas of the major (ox-1) and minor (ox-2) peaks.

In another example, other chromatographic methods such as size exclusion chromatography (SEC) can be used to determine the folding of a protein or the state of multimerization. SEC can be performed under native solution conditions, preserving macromolecular interactions. Size exclusion chromatography measures the hydrodynamic volume (not molecular weight), allowing folded and unfolded versions of the same protein to be distinguished. Quantitative assessment of aggregate levels in protein formulations by SEC is typically accomplished by UV detection, sometimes at multiple wavelengths, and often in combination with molecular weight characterization by multi-angle light scattering detection. SEC can also be employed to study reversible protein self-association (Chaudhury et al. (2014) The AAPS Journal 16(1):48-64).

iii. Differential Scanning Calorimetry

The thermostability of a polypeptide in solution, such as any ADA2 provided herein, including wildtype, variants and modified forms thereof can be determined using differential scanning calorimetry (DSC). In DSC, a sample cell (containing protein and buffer) and a reference cell (buffer only) are heated together to raise the temperature at a constant rate, and the excess heat required in the sample cell for maintaining equal temperature in both cells (due to transition from a folded, native state of protein to unfolded forms as temperature is increased) is recorded. The midpoint temperature of the thermal transition (or thermal melting temperature, $T_m$) is commonly used as an indicator of thermostability. DSC can also provide detailed information on the thermodynamic parameters of protein unfolding, including the change in enthalpy ($\Delta H$), entropy ($\Delta S$), Gibb's free energy ($\Delta G$), and heat capacity ($\Delta Cp$), if the experimental conditions allow reversible thermal transitions. DSC can be used to determine the effect of solution conditions (pH, ionic strength) and excipients on protein stability during protein formulation (Chaudhury et al. (2014) The AAPS Journal 16(1):48-64).

iv. Differential Scanning Fluorimetry

Differential scanning fluorimetry (DSF), also referred to as fluorescence thermal shift assay, is a method used to monitor thermal transitions of proteins, such as unfolding, in the presence of a fluorescent dye. The polarity-sensitive fluorescent dyes used for DSF are highly fluorescent in non-polar environment (e.g., in hydrophobic pockets of (partially) unfolded proteins), whereas the fluorescence is quenched in aqueous solution and/or in presence of native protein. DSF can be used to determine conformational stability of proteins. When the fluorescence intensity of the dye in presence of protein is plotted as a function of the temperature, the midpoints of transition temperatures ($T_h$) of the protein can be derived from the inflection point of the resulting sigmoidal graph. The $T_h$ values for various proteins in different solutions, as obtained from DSF experiments, are well correlated with thermal melting temperature ($T_m$) values determined by differential scanning calorimetry. In addition, information about the cooperative (two-state) or complex unfolding transitions in multi-domain proteins can be obtained by DSF (Chaudhury et al. (2014) The AAPS Journal 16(1):48-64).

The dye can be a small molecule, a peptide or a nucleic acid, and can be performed using a conventional real-time PCR instrument. Commonly used fluorescent dyes include SYRPO Orange, ANS, ROX™ and Nile red. For example, the melting temperature of any ADA2 provided herein, including wildtype, variants, conjugates or other modified forms, can be assessed using the ROX™ protein thermal shift dye (Applied Biosystems, Carlsbad, Calif.; Cat. No. 4461146) as the fluorescent dye, and the ViiA7 RT-PCR System (Applied Biosystems, Carlsbad, Calif.) to measure the shift in fluorescence as the temperature of the samples were increased.

v. Intrinsic Fluorescence Spectroscopy

The stability of a polypeptide, such as any ADA2 provided herein, including wildtype, variants, conjugates and other modified forms thereof can be determined by measuring changes in its intrinsic fluorescence. Intrinsic fluorescence spectroscopy detects the fluorescence from the internal fluorophores of proteins, such as the aromatic amino acid residues tryptophan and tyrosine. Properties of the fluorescence of tryptophan including its intensity and wavelength of maximum emission are especially sensitive to their local environment. As a result, the emission can often be used as probe to study changes in the higher-order structure of proteins. Protein unfolding is often accompanied by a decrease in fluorescence intensity and shift of maximum emission of Trp residues to longer wavelengths (red shift). Fluorometers equipped with plate reader and temperature control capability can be employed to assess the conformational stability of protein therapeutics. (Chaudhury et al. (2014) The AAPS Journal 16(1):48-64).

vi. Circular Dichroism

Circular dichroism (CD) spectroscopy measures the differential absorption of left and right circularly polarized light, and is a popular tool for characterizing a protein's secondary structure content (i.e., $\alpha$-helix and $\beta$-sheet) as a function of temperature and solution conditions. Far-UV CD spectra (160-250 nm) are used this purpose, while near-UV CD spectra (230-320 nm) can provide information about the local environment of aromatic amino acid side chains and disulfides, which can be then be used to monitor changes in tertiary structure. CD is incompatible with certain buffers and additives possessing high UV absorption (Chaudhury et al. (2014) The AAPS Journal 16(1):48-64).

vii. Dynamic Light Scattering

Dynamic light scattering (DLS), also known as photon correlation spectroscopy or quasi-elastic light scattering, is used to monitor changes in protein hydrodynamic properties in solution (e.g., aggregation) as well as making absolute size measurements. DLS measures the time-dependent fluctuation in the intensity of scattered light from a solution, and through autocorrelation analysis can provide information including diffusion coefficients, hydrodynamic radii, and size distribution of particles with sizes of a few nanometers up to about 1 µm. A DLS signal is very sensitive to the presence of the largest sized particle in solution. DLS is useful for detection of higher-order protein oligomers and aggregates. DLS has been employed to characterize the colloidal stability of protein therapeutics, such as monoclonal antibodies as a function of solution pH and temperature. DLS has also been applied to assess the aggregation propensity of proteins in response to the physical stresses present during the production, delivery and administration of many proteins (Chaudhury et al. (2014) The AAPS Journal 16(1):48-64). Formation of ADA2 aggregates after exposure to specific conditions can be determined by measuring the hydrodynamic radius of particles by dynamic light scattering under various conditions (e.g., denaturation conditions or other storage conditions).

viii. Static Light Scattering

Static light scattering (SLS) is a technique that measures the time-averaged intensity of scattered light, providing information about the size of particles suspended in solution. Multi-angle light scattering (MALS), a technique that collects and analyzes static light scattering intensity from multiple angles, can be used to determine the absolute molecular weight and radius of gyration of proteins and larger molecular weight oligomers. MALS detection can be coupled to size exclusion chromatography (SEC) or flow field fractionation (FFF) to separate and then characterize protein aggregates. Light scattering can also be measured with the fluorescence detection by simply scanning through the entire spectral region containing both the fluorescence and light scattering. This permits both conformational stability and aggregation data to be obtained (Chaudhury et al. (2014) The AAPS Journal 16(1):48-64).

ix. Turbidity Measurements

The magnitude of the turbidity (or optical density) of a solution is proportional to both the size and quantity of protein aggregates in solution (Optical density=Absorbance+Light scattering). Turbidity is usually measured in the wavelength range of 320-400 nm because proteins typically do not have significant absorbance in this wavelength range, and the magnitude of the light scattering signal is greater as the wavelength is lowered. During stability testing, the aggregation propensity of proteins in various formulations can be evaluated by either a temperature ramp method (measuring turbidity changes as a function of increasing temperature) or a kinetic method (measuring turbidity changes as a function of time at a constant temperature (Chaudhury et al. (2014) The AAPS Journal 16(1): 48-64).

x. Other Methods to Determine Stability

Other methods known to one of skill in the art that can be used to determine the stability of any ADA2 provided herein, including wildtype, variants and modified forms thereof in the method of treatment provided herein, include polyacrylamide gel electrophoresis (PAGE) and visual analysis of protein integrity, immunoblotting, nuclear magnetic resonance (NMR) spectroscopy, isothermal titration calorimetry, transverse urea gradient electrophoresis (TUG-PAGE), neutron scattering, analytical ultracentrifugation, tritium planigraphy and viscometric analysis. Visual analysis of protein integrity can include, for example, observation of lower molecular weight degradation products or higher molecular weight aggregation products in PAGE gels.

4. Assay for Therapeutic Activity

The therapeutic activity, such as an anticancer activity, of any of the ADA2 used in the method of treatment provided herein, can be measured using in vitro and in vivo functional assays. Provided herein are exemplary assays and systems used to monitor the therapeutic effect of treatment with any ADA2 provided herein.

a. In Vitro Tests

Anticancer activity of any ADA2 provided herein, including wildtype and variants, conjugates and other modified forms thereof, and combination therapy using any ADA2 provided herein and other agents, can be examined in vitro, for example, by incubating a cancer cell culture with the derivative, and then evaluating cell growth inhibition in the culture. Suitable cells for such testing include, but are not limited to, murine P388 leukemia, B16 melanoma and Lewis lung cancer cells, as well as MCF7 human breast cancer cells, OVCAR-3 cancer cells, A549 lung cancer cells, MX-1 human breast tumor cells, HT29 colon cancer cell line, HepG2 liver cancer cells, HCT116 colon cancer cells, Caco-2 human colonic cancer cells, U138MG human glioma cell line, DU 145 human prostate cancer cells, L1210 lymphatic leukemia cells, L4946 lymphatic leukemia cells, 6C3HED lymphosarcoma cells, TA3 mammary adenocarcinoma cells, E2 Ehrlich carcinoma cells, 755 adenocarcinoma cells, 180 sarcoma cells, and B16 melanoma cells.

Reversal of adenosine-mediated immunosuppression by any ADA2 provided herein, including wildtype and variants, conjugates and other modified forms thereof, and combination therapy using any ADA2 provided herein and other agents, can be examined in vitro, for example, by performing proliferation assays. Such assays include, but are not limited to T-cell proliferation assays or a mixture of NK and T (NK/T) cell proliferation assays, in the presence of adenosine and/or any ADA2 provided herein and/or any other combination therapy agents. For example, the immunosuppressive effect of adenosine on various immune cells, such as lymphocytes, natural killer (NK) cells, polymorphonuclear granulocytes, and phagocytic cells such as tissue macrophages, can be assessed by proliferation assays using the immune cells or mixtures thereof, such as the mixture of NK and T (NK/T) cells prepared from peripheral blood mononuclear cells (PBMC). The effect of any ADA2 provided herein and any other combination therapy agents provided herein, can be assessed by comparing the results of such proliferation assays in the presence of adenosine, with or without the addition of any ADA2 provided herein and/or any other combination therapy agents provided herein, including immune checkpoint inhibitors. Combination therapy agents are described in Section H.4 below.

Proliferation assays can be used to measure the activity of any ADA2 provided herein, including wildtype and variants, conjugates and other modified forms thereof, and combination therapy using any ADA2 provided herein and other agents, in the presence of adenosine. The assays can measure proliferation of immune cells whose activity is suppressed by the addition of adenosine. Cells can be incubated for a sufficient time for cells to exhibit proliferation (such as, for example, 12 hours, or 1, 2, 3, 4, 5, 6, 7 days, 2, 3, 4, 5 weeks or longer). Cell proliferation can be measured by any method known in the art, including $^3$H-thymidine incorporation assay, 5-bromo-2-deoxyuridine (BrdU), ELISA, tetrazolium microplate assay and acid phosphatase assay (e.g., Maghni et al. (1999) *J. Immunol. Method.* 223(2):185-194). Cell proliferation also can be measured using kits available from Invitrogen (Cyquant NF cell proliferation assay kit), Cambrex (ViaLight HS (high sensitivity) BioAssay), Promega (CellTiter-Glo Luminescent Cell Viability Assay), Guava Technologies (CellGrowth assay), Stratagene (Quantos cell proliferation assay) (e.g., Assays for Cell Proliferation Studies, *Genetic Eng. Biotechnol. News.* 26(6)). In some examples, the cell proliferation can be normalized to proliferation of cells in the presence of adenosine. In some examples, the cell proliferation can be normalized to proliferation of cells in the absence of adenosine. In exemplary proliferation assays, cells can be added to a well of a 96-well plate in normal growth medium that includes adenosine and any ADA2 provided herein or any other combination therapy agents to be assayed.

b. In Vivo Animal Models

Animal models can be used to assess the effects of therapeutic activity, such as tumor growth inhibition activity, provided herein, using any ADA2 provided herein. For example, animal models can be used to assess tumor size, volume or growth. In addition, animal models can be used to assess the pharmacokinetics or tolerability of the compositions or combinations.

Animal models can include, but are not limited to, mice, rats, rabbits, dogs, guinea pigs and non-human primate models, such as cynomolgus monkeys or rhesus macaques. Animal models including genetic models as well as xenograft models. For example, xenograft models include those in which, prior to testing the agents, tumors can be established in suitable test animals, such as immunodeficient or immunocompetent animals. In some examples, immunodeficient mice, such as nude mice or SCID mice, are transplanted with a tumor cell line, such as from an adenosine-associated cancer, to establish an animal model of that cancer. In other cases, syngeneic models employing immunocompetent animals are used.

Exemplary cell lines, including cancers associated with adenosine signaling, include, but are not limited to, CT26 murine colon cancer cells, MCF7 human breast cancer cells, HepG2 liver cancer cells, Caco-2 human colonic cancer cells, U138MG human glioma cell line, DU 145 human prostate cancer cells, L1210 lymphatic leukemia cells, L4946 lymphatic leukemia cells, 6C3HED lymphosarcoma cells, TA3 mammary adenocarcinoma cells, E2 Ehrlich carcinoma cells, 755 adenocarcinoma cells, 180 sarcoma cells, and B16 melanoma cells. Other cancer cells that can be used in animal xenograft models include PC3 prostate carcinoma cells, BxPC-3 pancreatic adenocarcinoma cells, MDA-MB-231 breast carcinoma cells, BT474 breast tumor cells, Tramp C2 prostate tumor cells, Mat-LyLu prostate cancer cells, MH194 mouse pancreatic carcinoma cells and KLN205 murine lung cancer cells.

Exemplary of an animal tumor model that can be used to assess the effect of cancer treatment using ADA2 provided herein is the CT26 syngeneic tumor model. This model is created by subcutaneous injection of CT26 murine primary colon carcinoma (ATCC CRL-2638) cells into syngeneic BALB/c mice. The mice are staged until the tumor is established, then the agent used for treatment, such as any ADA2 provided herein or combination therapy including ADA2 treatment, are administered. Another example of an animal tumor model of pancreatic cancer involves the generation of tumors in animals using BxPC-3 pancreatic adenocarcinoma cells (see e.g. Von Hoff et al. (2011) *J. Clin. Oncol.*, 29:4548-54). Other examples of animal tumor models include the murine MH194+PSC4 syngeneic tumor model and the murine lung cancer KLN205 syngeneic tumor model.

Other animal models, such as mouse models developed to study cancer immunotherapies or combination therapies, can be used to assess the therapeutic effect of treatment using ADA2. For example, mouse models developed to study both the efficacy of cancer immunotherapy and the immune-related adverse events (irAEs), can be used. Some cancer immunotherapies that target immunomodulatory receptors, such as anti-CTLA4 and anti-PD-1 combination therapy, can also elicit irAEs, such as rash, diarrhea, colitis and liver damage. Therefore, using mouse models that can mimic the kinetics of response that are observed in the clinic and models that can reflect possible irAEs can be used to assess both the efficacy and possible adverse events associated with treatment. Such models include those that are carcinogen-induced, such as methylcholanthrene (MCA)-induced fibrosarcomas and 7,12-dimethylbenz[α]anthracene (DMBA)/12-O-tetradecanoylphorbol-13-acetate (TPA)-induced skin papillomas or genetically engineered mouse tumour models, which have enforced expression of oncogenes and/or the loss of function of tumour suppressors, often in a tissue-specific and/or temporally controlled manner. Examples include the Her2/neu or PyMT transgenic mice to mimic breast cancer, the MT/ret model of spontaneous metastatic melanoma and BrafCATyr-creERT2Ptenfl/fl mice in which 4-hydroxytamoxifen (4-HT) induces de novo melanoma as well as the use of adenoviral vectors encoding Cre recombinase to selectively introduce mutations in the oncogene Kras and the tumour-suppressor gene Tp53 in the pulmonary epithelia to induce autochthonous lung tumours. Carcinogen-induced mouse models of cancer better mimic cancers that are immunogenic. Alternatively, in tumor explant models, tumors can be transplanted orthotopically, i.e. at the normal place of occurrence, rather than subcutaneously, to more accurately reflect the tumor microenvironment. Another exemplary mouse model to assess the efficacy and irAE of combination cancer immunotherapy is the Foxp3-DTR mice, which can be conditionally depleted of their Tregs to mimic the maximum suppression on all immune cells. This model allows the assessment of the efficacy of modulating co-inhibitory/co-stimulatory receptors or with other therapies to attenuate anti-tumour immunity/irAEs (Liu et al. (2014) Clinical & Translational Immunology 3:e22).

Genetic models also can be used in which animals are rendered to be deficient in one or more genes that results in tumor generation or formation. Such genetically engineered mouse models (GEMM) can recapitulate the molecular and clinical features of disease. For example, an exemplary pancreatic cancer genetic model involves the pancreatic specific expression of endogenous mutants Kras and Trp53 alleles, which results in mutant mice that exhibit a deficient phenotype (termed KPC mice; LSL-Kras$^{G12D}$, LSL-Trp53$^{R172H}$, Pdx-1-Cre). The KPC mice develop primary pancreatic tumors that exhibit features similar to human disease, including resistance to the nucleoside analog gemcitabine (see e.g. Frese et al. (2012) *Cancer Discovery*, 2:260-269).

i. Tumor Metabolic Activity

A reduction in tumor metabolic activity can be tested for ADA2 treatment provided herein. Tumor metabolic activity can be assessed using standard procedures known in the art. For example, [$^{18}$F]-fluorodeoxyglucose positron emission tomography (FDG-PET) can be used. PET is a non-invasive diagnostic that provides images and quantitative parameters of perfusion, cell viability, proliferation and/or metabolic activity of tissues. The images result from the use of different biological substances (e.g., sugars, amino acids, metabolic precursors, hormones) labelled with positron emitting radioisotopes. For example, FDG is an analogue of glucose and is taken up by living cells via the first stages of normal glucose pathway. In cancers, increased glycolytic activity exists resulting in trapping of FDG in the cancer cell. A decrease in FDG trapping correlates with a decreased tumor metabolic activity and anticancer activity. Guidelines for PET imaging are known to one of skill in the art and should be followed by any treating physician or technician.

ii. Tumor Size and Volume

For example, the tumor and/or metastasis size and location can be monitored. Tumor and or metastasis size can be monitored by any of a variety of methods known in the art, including external assessment methods or tomographic or magnetic imaging methods, such as the detection methods described herein. Monitoring size over several time points can provide information regarding the efficacy of the therapeutic methods provided herein. In addition, monitoring the increase or decrease in size of a tumor or metastasis, and can also provide information regarding the presence (i.e., detection and/or diagnosis) of additional tumors and/or metastases in the subject. Monitoring tumor size over several time points can provide information regarding the development of a neoplastic disease in a subject, including the efficacy of treatments of a neoplastic disease in a subject, such as the treatment provided herein.

In particular examples, reductions in tumor size and/or volume indicate that therapy is working. Tumor size and volume can be monitored based on techniques known to one of skill in the art. For example, tumor size and volume can be monitored by radiography, ultrasound imaging, necropsy, by use of calipers, by microCT or by $^{18}$F-FDG-PET. Tumor size also can be assessed visually. In particular examples, tumor size (diameter) is measured directly using calipers.

In other examples, tumor volume can be measured using an average of measurements of tumor diameter (D) obtained by caliper or ultrasound assessments. For example, tumor volume can be determined using VisualSonics Vevo 770 high-resolution ultrasound or other similar ultrasound. The volume can be determined from the formula $V=D^3\times\pi/6$ (for diameter measured using calipers) or $V=D^2\times d\times\pi/6$ (for diameter measured using ultrasound where d is the depth or thickness). For example, caliper measurements can be made of the tumor length (l) and width (w) and tumor volume calculated as length×width$^2$×0.52. In another example, microCT scans can be used to measure tumor volume (see e.g., Huang et al. (2009) *PNAS*, 106:3426-3430). As an example, mice can be injected with Optiray Pharmacy ioversol injection 74% contrast medium (e.g., 741 mg of ioversol/mL), mice anesthetized, and CT scanning done using a MicroCat 1A scanner or other similar scanner (e.g., IMTek) (40 kV, 600 µA, 196 rotation steps, total angle or rotation=196). The images can be reconstructed using software (e.g., RVA3 software program; ImTek). Tumor volumes can be determined by using available software (e.g., Amira 3.1 software; Mercury Computer Systems). Tumor volume or size also can be determined based on size or weight of a tumor.

The percent of tumor growth inhibition can be calculated based on the volume using the equation: % TGI=$[1-(T_n-T_0)\div(C_n-C_0)]\times 100\%$, where "$T_n$" is the average tumor volume for the treatment group at day "n" after the final dose of ADA2; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment. Statistical analysis of tumor volumes can be determined.

c. Clinical Monitoring

The methods provided herein can further include one or more steps of monitoring treatment effect, such as tumor treatment using any of the ADA2 provided herein. Subjects can be monitored by monitoring the tumor, the general health of the subject and/or course of disease in the subject. Any of a variety of monitoring steps can be included in the methods provided herein, including, but not limited to, monitoring tumor size, monitoring anti-(tumor antigen) antibody titer, monitoring the presence and/or size of metastases, monitoring the subject's lymph nodes, and monitoring the subject's weight or other health indicators including blood or urine markers. The purpose of the monitoring can be for assessing the health state of the subject or the progress of therapeutic treatment of the subject, or can be for determining whether or not further administration of ADA2 is warranted, or for determining when or whether or not to administer a further agent or treatment, or can be for determining whether or not to administer or continue combination therapy.

Parameters indicative of the health of a subject also can be monitored. Monitoring the health of a subject can be used to determine the efficacy of the therapeutic method, as is known in the art. Any of a variety of health diagnostic methods for monitoring disease such as neoplastic disease or other disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, or reactive protein concentration.

5. Pharmacodynamics/Pharmacokinetics and Tolerability

The effect of administration of any ADA2 provided herein, including wildtype, variants and modified forms thereof, alone or in combination with another therapeutic agent, on the pharmacokinetic and pharmacodynamic properties of any administered agent also can be assessed in vivo using animal models and/or human subjects, such as in the setting of a clinical trial. Pharmacokinetic or pharmacodynamic studies can be performed using animal models or can be performed during studies with patients administered with any ADA2 provided herein, including wildtype, variants and modified forms thereof.

Animal models include, but are not limited to, mice, rats, rabbits, dogs, guinea pigs and non-human primate models, such as cynomolgus monkeys or rhesus macaques. In some instances, pharmacokinetic or pharmacodynamic studies are performed using healthy animals. In other examples, the studies are performed using animal models of a disease for which therapy with ADA2 is considered, such as animal models of any adenosine-associated disease or disorder, for example a tumor model.

The pharmacokinetic properties of any ADA2 provided herein, including wildtype, variants and modified forms thereof, can be assessed by measuring such parameters as the maximum (peak) concentration ($C_{max}$), the peak time (i.e., when maximum concentration occurs; $T_{max}$), the minimum concentration (i.e., the minimum concentration between doses; $C_{max}$), the elimination half-life ($T_{1/2}$) and area under the curve (i.e., the area under the curve generated by plotting time versus concentration; AUC), following administration. The absolute bioavailability of the ADA2 can be determined by comparing the area under the curve of ADA2 following subcutaneous delivery ($AUC_{sc}$) with the AUC of ADA2 following intravenous delivery ($AUC_{iv}$). Absolute bioavailability (F), can be calculated using the formula: F=$([AUC]_{sc}\times dose_{sc})/([AUC]_{iv}\times dose_{iv})$. A range of doses and different dosing frequency of dosing can be administered in the pharmacokinetic studies to assess the effect of increasing or decreasing concentrations of the enzyme, such as any ADA2 provided herein, including wildtype, variants and modified forms thereof, in the dose.

Studies to assess the safety and tolerability of a treatment also are known in the art and can be used herein. Following administration of any of the ADA2 provided herein, or any combination therapy provided herein, the development of any adverse reactions can be monitored. Adverse reactions can include, but are not limited to, injection site reactions, such as edema or swelling, headache, fever, fatigue, chills, flushing, dizziness, urticaria, wheezing or chest tightness, nausea, vomiting, rigors, back pain, chest pain, muscle cramps, seizures or convulsions, changes in blood pressure and anaphylactic or severe hypersensitivity responses. Typically, a range of doses and different dosing frequencies can be administered in the safety and tolerability studies to assess the effect of increasing or decreasing concentrations of any ADA2 or agents used in combination therapy in the dose.

G. PHARMACEUTICAL COMPOSITIONS AND FORMULATIONS

Provided herein are pharmaceutical compositions containing an adenosine deaminase 2 (ADA2), such as a wildtype ADA2, variants, conjugates or other modified forms thereof, and a pharmaceutically acceptable excipient or additive. The pharmaceutical compositions can be use in treatment of diseases or conditions associated with elevated adenosine levels (e.g., hyperproliferative disease or condition, such as a tumor or cancer). Any of the ADA2 can be administered in a single agent therapy, or can be administered in a combination therapy with a further agent or treatment as described herein. The compositions can be formulated for single dosage administration or for multiple dosage administration. The agents can be formulated for direct administration. The compositions can be provided as a liquid or lyophilized formulation.

Pharmaceutically acceptable compositions are prepared in view of approvals for a regulatory agency or other agency prepared in accordance with generally recognized pharmacopeia for use in animals and in humans. The compositions can be prepared as solutions, suspensions, powders, or sustained release formulations. Typically, the compounds are formulated into pharmaceutical compositions using techniques and procedures well known in the art (see e.g., Ansel *Introduction to Pharmaceutical Dosage Forms*, Fourth Edition, 1985, 126). The formulation should suit the mode of administration.

Compositions can be formulated for administration by any route known to those of skill in the art including intramuscular, intravenous, intradermal, intralesional, intraperitoneal injection, subcutaneous, intratumoral, epidural, nasal, oral, vaginal, rectal, topical, local, otic, inhalational, buccal (e.g., sublingual), and transdermal administration or any route. Other modes of administration also are contemplated. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature of the disease, the progress of the disease, the severity of the disease and the particular composition which is used. Pharmaceutical compositions can be formulated in dosage forms appropriate for each route of administration. In particular, the compositions can be formulated into any suitable pharmaceutical preparations for systemic, intraperitoneal, oral or direct administration. For example, the compositions can be formulated for administration subcutaneously, intramuscularly, intratumorally, intravenously or intradermally. In some embodiments, the compositions contain nucleic acids that encode the variant ADA2 polypeptide provided herein, such as oncolytic viral vectors or gene therapy vectors, or cells, such as modified immune cells for adoptive immunotherapy, and particular compositions can be formulated in dosage forms appropriate for the particular composition.

Administration methods can be employed to decrease the exposure of the active agent to degradative processes, such as proteolytic degradation and immunological intervention via antigenic and immunogenic responses. Examples of such methods include local administration at the site of treatment or continuous infusion (e.g., of ADA2 polypeptide or variant thereof).

The compounds can be formulated into suitable pharmaceutical preparations such as solutions, suspensions, tablets, dispersible tablets, pills, capsules, powders, sustained release formulations or elixirs, for oral administrations well as transdermal patch preparation and dry powder inhalers. Typically, the compounds are formulated into pharmaceutical compositions using techniques and procedures well known in the art (see e.g., Ansel *Introduction to Pharmaceutical Dosage Forms*, Fourth Edition, 1985, 126). Generally, the mode of formulation is a function of the route of administration. Generally, the compositions are formulated in lyophilized or liquid form. Where the compositions are provided in lyophilized form they can be reconstituted just prior to use by an appropriate buffer, for example, a sterile saline solution.

1. Formulations—Liquids, Injectables, Emulsions

The formulation generally is made to suit the route of administration. Parenteral administration, generally characterized by injection or infusion, either subcutaneously, intramuscularly, intravenously or intradermally is contemplated herein. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. Injectables can be prepared in conventional forms, either as liquid solutions or suspensions, solid forms suitable for solution or suspension in liquid prior to injection, or as emulsions. Lyophilized formulations are ideal for storage of large unit doses for later use or storage.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. The pharmaceutical preparations also can be provided in a dosage form that does not require dilution for use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Injectables are designed for local and systemic administration. Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions can be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutical compositions can include carriers or other excipients. For example, pharmaceutical compositions provided herein can contain any one or more of a diluents(s), adjuvant(s), antiadherent(s), binder(s), coating(s), filler(s), flavor(s), color(s), lubricant(s), glidant(s), preservative(s), detergent(s), sorbent(s) or sweetener(s) and a combination thereof or vehicle with which a modified PH20 polypeptide is administered. For example, pharmaceutically acceptable carriers or excipients used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Formulations, including liquid preparations, can be prepared by conventional means with pharmaceutically acceptable additives or excipients.

Pharmaceutical compositions can include carriers such as a diluent, adjuvant, excipient, or vehicle with which the composition are administered. Examples of suitable pharmaceutical carriers are described in "Remington's Pharmaceutical Sciences" by E. W. Martin. Such compositions will contain a therapeutically effective amount of the compound or agent, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. For example, suitable excipients are, for example, water, saline, dextrose, glycerol or ethanol. A composition, if desired, also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

In particular, antimicrobial agents (e.g., preservatives) in bacteriostatic or fungistatic concentrations (e.g., an antimicrobial effective amount) can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride.

The pharmaceutical compositions also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) also is contemplated herein. The percentage of active compound contained in such parenteral compositions is highly dependent on the specific nature thereof, as well as the activity of the compound and the needs of the subject.

Lyophilized Powders

Of interest herein are lyophilized powders, which can be reconstituted for administration as solutions, emulsions and other mixtures. They can also be reconstituted and formulated as solids or gels. The lyophilized powders can be prepared from any of the solutions described above. The pharmaceutical preparations can be presented in lyophilized form for reconstitution with water or other suitable vehicle before use.

The sterile, lyophilized powder is prepared by dissolving a compound in a buffer solution. The buffer solution can contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, a selected enzyme, agent or compound is added to the resulting mixture, and stirred until it dissolves. The resulting mixture is sterile filtered or treated to remove particulates and to insure sterility, and apportioned into vials for lyophilization. Each vial will contain a single dosage (1 mg-1 g, generally 1-100 mg, such as 1-5 mg) or other dosages as described herein, or multiple dosages of the compound. The lyophilized powder can be stored under appropriate conditions, such as at about 4° C. to room temperature.

Reconstitution of this lyophilized powder with a buffer solution provides a formulation for use in parenteral administration. The precise amount depends upon the indication treated and selected compound. Such amount can be empirically determined.

2. Compositions for Other Routes of Administration

Depending upon the condition treated other routes of administration, such as topical application, transdermal patches, oral and rectal administration are also contemplated herein.

For example, pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (*theobroma* oil), glycerin-gelatin, carbowax (polyoxyethylene glycol) and appropriate mixtures of mono-, di- and triglycerides of fatty acids. Combinations of the various bases can be used. Agents to raise the melting point of suppositories include spermaceti and wax. Rectal suppositories can be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration. Formulations suitable for rectal administration can be provided as unit dose suppositories. These can be prepared by admixing the active compound with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Topical mixtures are prepared as described for the local and systemic administration. The resulting mixtures can be solutions, suspensions, emulsion or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds or pharmaceutically acceptable derivatives thereof can be formulated as aerosols for topical application, such as by inhalation (see, e.g., U.S. Pat. Nos. 4,044,126, 4,414,209, and 4,364,923, which describe aerosols for delivery of a steroid useful for treatment of inflammatory diseases, particularly asthma). These formulations, for administration to the respiratory tract, can be in the form of an aerosol or solution for a nebulizer, or as a microfine powder for insufflation, alone or in combination with an inert carrier such as lactose. In such a case, the particles of the formulation will typically have diameters of less than 50 microns, or less than 10 microns.

The compounds can be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in an optionally buffered aqueous solution of, for example, 0.1 to 0.2 M concentration with respect to the active compound. Formulations suitable for transdermal administration also can be delivered by iontophoresis (see, e.g., Tyle, P, *Pharmaceutical Research* 3(6):318-326 (1986)) and typically take the form of an optionally buffered aqueous solution of the active compound.

Pharmaceutical compositions also can be administered by controlled release formulations and/or delivery devices (see e.g., in U.S. Pat. Nos. 3,536,809; 3,598,123; 3,630,200; 3,845,770; 3,916,899; 4,008,719; 4,769,027; 5,059,595; 5,073,543; 5,120,548; 5,591,767; 5,639,476; 5,674,533 and 5,733,566).

3. Dosages and Administration

The ADA2 in the composition, such as any described herein including wildtype, variant, conjugate or other modified form, can be formulated as pharmaceutical compositions for single dosage or multiple dosage administration. The protein can be included in an amount sufficient to exert a therapeutically useful effect in the absence of undesirable side effects on the patient treated. For example, the concentration of the pharmaceutically active compound is adjusted so that an injection provides an effective amount to produce the desired pharmacological effect. The therapeutically effective concentration can be determined empirically by testing the protein in known in vitro and in vivo systems such as by using the assays described herein or known in the art. For example, standard clinical techniques can be employed. In addition, in vitro assays and animal models can be employed to help identify optimal dosage ranges. The precise dose, which can be determined empirically, can depend on the age, weight and condition of the patient or animal, the particular ADA2 molecule being administered, the route of administration, the type of disease to be treated and the seriousness of the disease.

Hence, it is understood that the precise dosage and duration of treatment is a function of the disease being treated and can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

Compositions of an ADA2 protein, such as a wildtype, variant, conjugate or other modified forms thereof, are included in the composition in an amount sufficient to exert a therapeutically useful effect. For example, the amount is one that achieves a therapeutic effect in the treatment of a hyperproliferative disease or condition, such as cancer.

Generally, compositions contain 0.5 µg to 100 grams of an ADA2 protein, for example, 20 µg to 10 gram, 20 µg to 50 grams, 20 µg to 1 grams, 20 µg to 500 mg, 20 µg to 200 mg, 20 µg to 5 mg, 20 µg to 0.5 mg, 0.5 mg to 100 grams, 0.5 mg to 10 grams, 0.5 mg to 5 grams, 0.5 mg to 1 gram, 0.5 mg to 500 mg, 0.5 mg to 200 mg, 0.5 mg to 5 mg, 5 mg to 100 gram, 5 mg to 10 grams, 5 mg to 5 grams, 5 mg to 1 gram, 5 mg to 500 mg, 5 mg to 200 mg, 100 mg to 100 gram, 100 mg to 10 grams, 100 mg to 5 grams, 100 mg to 1 gram, 100 mg to 500 mg, 100 mg to 200 mg, 200 mg to 100 gram, 200 mg to 10 grams, 200 mg to 5 grams, 200 mg to 1 gram, 200 mg to 500 mg, 500 mg to 100 gram, 500 mg to 10 grams, 500 mg to 5 grams, 500 mg to 1 gram, 1 gram to 100 gram, 1 gram to 10 grams, 1 gram to 5 grams, 5 grams to 100 grams, 5 grams to 10 grams, or 10 grams to 100 grams. For example, the composition can contain an amount of ADA2 that is at least or at least about or is 1 mg, 5 mg, 10 mg, 20 mg, 30 mg, 40 mg, 50 mg, 60 mg, 70 mg, 80 mg, 90 mg, 100 mg, 200 mg, 300 mg, 400 mg, 500 mg, 600 mg, 700 mg, 800 mg, 900 mg, 1 gram, 5 grams, 10 grams, 20 grams, 30 grams, 40 grams, 50 grams, 60 grams, 70 grams, 80 grams, 90 grams, 100 grams, 200 grams, 300 grams or more.

In further examples, the composition contains between or between about 1 milliunits (mU) and 10,000 units (U), 1 mU and 1,000 U, 1 mU and 100 U, 1 mU and 10 U, 1 mU and 1 U, 1 mU and 100 mU, 1 mU and 10 mU, 10 mU and 10,000 U, 10 mU and 1,000 U, 10 mU and 100 U, 10 mU and 10 U, 10 mU and 1 U, 10 mU and 100 mU, 100 mU and 10,000 U, 100 mU and 1,000 U, 100 mU and 100 U, 100 mU and 10 U, 100 mU and 1 U, 1 U and 10,000 U, 1 U and 1,000 U, 1 U and 100 U, 1 U and 10 U, 10 U and 10,000 U, 10 U and 1,000 U, 10 U and 100 U, 100 U and 10,000 U, 100 U and 1,000 U, 1,000 U and 10,000 U, of ADA2. For example, the composition can contain an amount of ADA2 that is at least or at least about or is 1 mU, 2 mU, 3 mU, 4 mU, 5 mU, 6 mU, 7 mU, 8 mU, 9 mU, 10 mU, 20 mU, 30 mU, 40 mU, 50 mU, 60 mU, 70 mU, 80 mU, 90 mU, 100 mU, 200 mU, 300 mU, 400 mU, 500 mU, 600 mU, 700 mU, 800 mU, 900 mU, 1 U, 10U, 20 U, 30 U, 40 U, 50 U, 60 U, 70 U, 80 U, 90 U, 100 U, 200 U, 300 U, 400 U, 500 U, 600 U, 700 U, 800 U, 900 U, 1000 U, 2000 U, 3000 U, 4000 U, 5000 U, 6000 U, 7000 U, 8000 U, 9000 U, 10000 U or more.

The volume of the composition containing the ADA2 provided herein can be between or can be between about 0.1 mL and 100 mL, such as 0.5 mL and 100 mL, 0.5 mL and 50 mL, 0.5 mL and 10 mL, 1 mL and 100 mL, 1 mL and 50 mL, 1 mL and 40 mL, 1 mL and 20 mL, 1 mL and 10 mL, or 3 mL and 10 mL. Typically, volumes of injections or infusions of a composition are at least or at least about 0.01 mL, 0.05 mL, 0.1 mL, 0.2 mL, 0.3 mL, 0.4 mL, 0.5 mL, 1 mL, 2 mL, 3 mL, 4 mL, 5 mL, 6 mL, 7 mL, 8 mL, 9 mL, 10 mL, 20 mL, 30 mL, 40 mL, 50 mL or more.

Any ADA2 provided herein, wildtype, variants or conjugate (e.g. PEGylated ADA2), can be provided at a concentration of at or about or at least or at least about 1 mU/mL, 10 mU/mL, 20 mU/mL, 10 mU/mL, 20 mU/mL, 30 mU/mL, 40 mU/mL, 50 mU/mL, 60 mU/mL, 70 mU/mL, 80 mU/mL, 90 mU/mL, 100 mU/mL, 200 mU/mL, 300 mU/mL, 400 mU/mL, 500 mU/mL, 600 mU/mL, 700 mU/mL, 800 mU/mL, 900 mU/mL, 1 U/mL, 2 U/mL, 3 U/mL, 4 U/mL, 5 U/mL, 6 U/mL, 7 U/mL, 8 U/mL, 9 U/mL, 10 U/mL, 20 U/mL, 30 U/mL, 40 U/mL, 50 U/mL, 100 U/mL, 150 U/mL, 200 U/mL, 250 U/mL, 400 U/mL, 500 U/mL, 1000 U/mL, 2000 Units/mL, 3000 U/mL, 4000 U/mL, 5000 U/mL, 6000 U/mL, 7000 U/mL, 8000 U/mL, 9000 U/mL, or 10,000 U/mL. The composition can be prepared for use directly or for dilution to the effective concentration prior to use.

Pharmaceutically and therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Unit dosage forms, include, but are not limited to, tablets, capsules, pills, powders, granules, sterile parenteral solutions or suspensions, and oral solutions or suspensions, and oil water emulsions containing suitable quantities of the compounds or pharmaceutically acceptable derivatives thereof. Unit dose forms can be contained in ampoules and syringes or individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared. Pharmaceutical composition can be formulated in dosage forms appropriate for each route of administration.

The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

As indicated, compositions provided herein can be formulated for any route known to those of skill in the art including, but not limited to, subcutaneous, intramuscular, intravenous, intradermal, intralesional, intraperitoneal injection, epidural, vaginal, rectal, local, otic, transdermal administration or any route of administration. Formulations suited for such routes are known to one of skill in the art. Compositions also can be administered with other biologically active agents, either sequentially, intermittently or in the same composition.

Pharmaceutical compositions can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,660; 4,769,027; 5,059,595; 5,073,543; 5,120,548; 5,354,556; 5,591,767; 5,639,476; 5,674,533 and 5,733,566).

Various delivery systems are known and can be used to administer selected compositions, such as but not limited to, encapsulation in liposomes, microparticles, microcapsules, recombinant cells capable of expressing the compound, receptor mediated endocytosis, and delivery of nucleic acid molecules encoding an ADA2, such as wildtype, variant or modified forms thereof, or other agent such as retrovirus delivery systems. In some embodiments, the compositions contain nucleic acids that encode the variant ADA2 polypeptide provided herein, such as oncolytic viral vectors or gene therapy vectors, or cells, such as modified immune cells for adoptive immunotherapy, and particular compositions can be administered in delivery systems appropriate for the particular composition.

Hence, in certain embodiments, liposomes and/or nanoparticles also can be employed with administration of compositions and combinations herein. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core. In some embodiments, the liposomes can be multivesicular liposomes (MVL).

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use herein, and such particles can be easily made.

4. Packaging and Articles of Manufacture

Also provided are articles of manufacture containing packaging materials, any pharmaceutical composition provided herein, and a label that indicates that the compositions are to be used for treatment of diseases or conditions as described herein. For example, the label can indicate that the treatment is for a tumor or cancer. The label also can indicate that the treatment is for a disease or condition associated with an elevated marker as described herein, such as elevated or accumulated adenosine levels on tissues or cells, elevated adenosine receptor (ADR) and/or elevated CD73 or CD39 levels.

Combinations of an ADA2 protein described herein, including a variant, conjugate (e.g. PEGylated ADA2) or other modified form, and another therapeutic agent also can be packaged in an article of manufacture. In one example, the article of manufacture contains a pharmaceutical composition containing an ADA2, such as any ADA2 provided herein, and no further agent or treatment. In other examples, the article of manufacture contains a pharmaceutical composition containing an ADA2 and another further therapeutic agent. For example, the article of manufacture contains a pharmaceutical composition containing an ADA2 and another treatment such as an immune checkpoint inhibitor agent or an antitumor agent. In this example, the agents can be provided together or separately, for packaging as articles of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. Exemplary of articles of manufacture are containers including single chamber and dual chamber containers. The containers include, but are not limited to, tubes, bottles and syringes. The containers can further include a needle for intravenous administration.

The choice of package depends on the agents, and whether such compositions will be packaged together or separately. In general, the packaging is non-reactive with the compositions contained therein. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

Selected compositions including articles of manufacture thereof also can be provided as kits. Kits can include a pharmaceutical composition described herein and an item for administration provided as an article of manufacture. For example an ADA2 can be supplied with a device for administration, such as a syringe, an inhaler, a dosage cup, a dropper, or an applicator. The compositions can be contained in the item for administration or can be provided separately to be added later. The kit can, optionally, include instructions for application including dosages, dosing regimens and instructions for modes of administration. Kits also can include a pharmaceutical composition described herein and an item for diagnosis.

H. METHOD OF TREATMENT WITH AN ADENOSINE DEAMINASE 2 (ADA2)

The methods provided herein include methods of administering or using any adenosine deaminase 2 (ADA2) described herein, such as wildtype, variant, conjugate (e.g. PEGylated ADA2) or other modified forms thereof, for treating subjects having a disease or condition whose symptoms can be ameliorated or lessened by a reduction in adenosine or deoxyadenosine levels in the subject. For example, the disease or condition is one that is associated with elevated adenosine levels. For example, since ADA2 exhibits a low binding affinity for adenosine with a Km of about $200 \times 10^{-5}$M, it preferentially exhibits activity under conditions of elevated or higher levels of adenosine. Thus, the use of ADA2 as a therapeutic offers the benefit of exhibiting specificity for disease or aberrant environments, while not exhibiting activity under normal environments in which adenosine levels are lower. In particular examples, as described below, the disease or condition is a tumor or a cancer. The subject can be selected based on levels of extracellular adenosine, level of adenosine receptor (ADR) expression, and/or level of ectonucleotidase expression.

Additionally, methods of combination therapies with one or more additional agents for treatment, such as an anticancer agent or an anti-hyaluronan agent, also are provided.

1. Exemplary Diseases and Conditions

The concentrations of adenosine, which is physiologically present in the interstitial fluids of unstressed tissues at low levels, can rapidly increase in response to pathological conditions, such as hypoxia, ischemia, tumor environment or trauma. When released into the extracellular space, adenosine functions as a danger signal and through the activation of adenosine receptors (ADRs), various cellular responses are generated to restore tissue homeostasis. Adenosine is associated with a variety of activities that can contribute to the etiology of diseases and conditions, including, but not limited to, stimulation of tumor growth and angiogenesis, inhibition of cytokine synthesis and adhesion of immune cells to the endothelial wall, inhibition of the function of T-cells, macrophages, and natural killer cells, and promotion of tumor metastasis.

Adenosine deaminases, such as any ADA2 or variants, conjugates or other modified forms thereof described herein, can modulate the extracellular adenosine levels in such conditions by deaminating the adenosine molecules to inosine. Hence, any of such diseases can be treated with an ADA2 described herein, such as a wildtype, variant, conjugate (e.g. PEGylated ADA2) or other modified form. In particular, ADA2 possesses properties that contribute to extracellular stability, such as extensive glycosylation and presence of conserved disulfide bonds, that make it a desirable therapeutic. Provided herein are exemplary diseases and conditions in which ADA2 treatment can be used.

Compositions containing an ADA2 can be administered by any route that is desired for treatment of the disease or condition. The particular route of administration can depend on the particular disease or condition, the severity of the disease or condition, the particular formulation and other factors within the level of a skilled artisan. Typically, the compositions are administered by intravenous route, although other routes of administration are contemplated, such as any route known to those of skill in the art including intramuscular, intraperitoneal, intravenous, intradermal, intralesional, intraperitoneal injection, epidural, vaginal, rectal, local, otic, transdermal administration or any route of administration.

a. Cancers and Tumors

ADA2, such as any described herein, including a wildtype, variant, conjugate (e.g. PEGylated ADA2) or other modified form, can be used to treat a tumor or cancer. High extracellular adenosine in the tumor microenvironments (TME) creates a local immunosuppressive environment, and suppresses the activity of T and NK cells. Through the generation of immunosuppressive TME and ADR signaling to specific tumor and immune cells, adenosine generally creates a TME that is favorable to tumor growth, vascularization and metastasis.

Agents that modulate adenosine signaling have been shown to have effects in inhibiting tumor growth and modulating downstream cell signaling in a variety of cancer types, such as breast cancer, lung cancer, colon carcinoma, prostate cancer and melanoma cells (Antonioli et al. (2013) Nat Rev Can 13:842-857). Adenosine deaminases, such as any ADA2 or variants, conjugates, or modified forms thereof described herein, can modulate the extracellular adenosine levels in the tumor environment, by deaminating the adenosine molecules to inosine. Thus, any ADA2, variant, conjugate (e.g. PEGylated ADA2), or modified forms thereof can be used as an agent to modulate adenosine levels and signaling, reverse immunosuppression of anti-tumor immune response, and ultimately reduce tumor growth.

In particular, the diseases and conditions that can be treated or ameliorated by the methods provided herein include, for example, those in which tumor growth is stimulated through high adenosine concentration and/or adenosine receptor (ADR) signaling. For example, TME that actively produces a high concentration of adenosine, thereby creating a local immunosuppressive environment, can be more susceptible to ADA2 treatment. Compared to normal adenosine levels of about or approximately 0.1 micromolar, the adenosine levels in the TME rise to about 10 micromolar. Since ADA2 has a high Km and is preferentially active in conditions containing elevated adenosine, as commonly present in the tumor microenvironment (TME), ADA2 can reduce the adenosine levels in the TME by its adenosine deaminase activity. Any ADA2 provided herein, including ADA2 wildtype, variants and modified forms thereof, can be used to treat tumors, including solid tumors, with a high adenosine concentration in the TME.

In addition, as shown herein, ADA2, or variants, also exhibit various pH optima that can preferentially target regions within the TME. For example, hypoxic regions of the TME generally have a low pH of about or approximately pH 6.5, which is the same as the pH optimum of ADA2. For example, an altered pH is a common microenvironment found in disease states such as in the TME (see e.g. Fogh Andersen et al. (1995) *Clin. Chem.*, 41:1522-1525; Bhujwalla et al. (2002) *NMR Biomed.*, 15:114-119; Helmlinger et al. (1997) *Nature Med.*, 3:177; Gerweck and Seetharaman (1996), Cancer Res. 56(6):1194-1198). For example, in many tumors, Warburg effect creates a microenvironment with a pH ranging from about 5.6 to about 6.8, such as less than or about or pH 5.6, 5.7, 5.8, 5.9, 6.0, 6.1, 6.2, 6.3, 6.4, 6.5, 6.6, 6.7, or 6.8. Thus, ADA2 that are more active at acidic pH than at neutral pH, such as ADA2 wildtype or variants described herein, can be used to treat tumors within the low pH TME, while minimizing activity in non-target disease cells or tissues.

Thus, administering any ADA2 provided herein to reduce the adenosine concentration in the TME by the enzymatic conversion of adenosine to inosine can be used to prevent tumor growth and metastasis, while minimizing activity at non-target disease cells or tissues.

The methods provided herein are applicable to treating all types of tumors, including cancers, that are associated with elevated adenosine levels and/or susceptible to a reduction in adenosine or deoxyadenosine levels in the subject to be treated. Broadly, these include tumors of the blood as well as solid tumors. Included among the tumors are those whose growth is suppressed when adenosine levels are reduced. Included among the tumors are those in which reduced adenosine levels allow the subject's immune system to more effectively suppress the growth of the tumor, and/or tumors whose growth is suppressed when reduced levels of adenosine inhibits the blood supply, e.g., hypoxic tumors. In particular, solid tumors are susceptible to treatment by the methods provided herein, because they are more sensitive to the reduction in tumor angiogenesis, resulting from the reduced adenosine levels. High adenosine levels in sections of the TME promotes angiogenesis, and the reduction of adenosine levels using the methods provided herein can result in reduction of the angiogenic effect of adenosine. In addition, high adenosine levels and CD73 activity are associated with cancer cell dissemination and metastasis. Thus, reduction of adenosine levels, effected by the administration of any ADA2 provided herein, can result in the suppression of cancer cell dissemination and metastasis.

Tumors subject to treatment by the methods provided herein include, but are not limited to, those that originate in the immune system, skeletal system, muscles and heart, breast, gastrointestinal tract, central and peripheral nervous system, renal system, reproductive system, respiratory system, skin, connective tissue systems, including joints, fatty tissues, and circulatory system, including blood vessel walls. Examples of tumors that can be treated by administering any ADA2 or variant or modified form thereof provided herein include carcinomas, gliomas, sarcomas (including liposarcoma), adenocarcinomas, adenosarcomas, and adenomas. Such tumors can occur in virtually all parts of the body, including, for example, breast, heart, lung, small intestine, colon, spleen, kidney, bladder, head and neck, ovary, prostate, brain, pancreas, skin, bone, bone marrow, blood, thymus, uterus, testicles, cervix or liver.

Tumors of the skeletal system include, for example, sarcomas and blastomas such as osteosarcoma, chondrosarcoma, and chondroblastoma. Muscle and heat tumors include tumors of both skeletal and smooth muscles, e.g., leiomyomas (benign tumors of smooth muscle), leiomyosarcomas, rhabdomyomas (benign tumors of skeletal muscle), rhabdomyosarcomas, cardiac sarcoma. Tumors of the gastrointestinal tract include e.g., tumors of the mouth, esophagus, stomach, small intestine, colon and colorectal tumors, as well as tumors of gastrointestinal secretory organs such as salivary glands, liver, pancreas, and the biliary tract. Tumors of the central nervous system include tumors of the brain, retina, and spinal cord, and can also originate in associated connective tissue, bone, blood vessels or nervous tissue. Treatment of tumors of the peripheral nervous system are also contemplated. Tumors of the peripheral nervous system include malignant peripheral nerve sheath tumors. Tumors of the renal system include those of the kidneys, e.g., renal cell carcinoma, as well as tumors of the ureters and bladder. Tumors of the reproductive system include tumors of the cervix, uterus, ovary, prostate, testes and related secretory glands. Tumors of the immune system include both blood based and solid tumors, including lymphomas, e.g., both Hodgkin's and non-Hodgkin's. Tumors of the respiratory system include tumors of the nasal passages, bronchi and lungs. Tumors of the breast include, e.g., both lobular and ductal carcinoma.

Other examples of tumors that can be treated with any ADA2 or variant or modified form thereof provided herein include Kaposi's sarcoma, CNS neoplasms, neuroblastomas, capillary hemangioblastomas, meningiomas and cerebral metastases, melanoma, gastrointestinal and renal carcinomas and sarcomas, rhabdomyosarcoma, glioblastoma (such as glioblastoma multiforme) and leiomyosarcoma. Examples of cancer that can be treated with any ADA2 or variant or modified form thereof provided herein include but are not limited to lymphoma, blastoma, neuroendocrine tumors, mesothelioma, schwannoma, meningioma, melanoma, and leukemia or lymphoid malignancies. Examples of such cancers include hematologic malignancies, such as Hodgkin's lymphoma; non-Hodgkin's lymphomas (Burkitt's lymphoma, small lymphocytic lymphoma/chronic lymphocytic leukemia, mycosis fungoides, mantle cell lymphoma, follicular lymphoma, diffuse large B-cell lymphoma, marginal zone lymphoma, hairy cell leukemia and lymphoplasmacytic leukemia), tumors of lymphocyte precursor cells, including B-cell acute lymphoblastic leukemia/lymphoma, and T-cell acute lymphoblastic leukemia/lymphoma, thymoma, tumors of the mature T and NK cells, including peripheral T-cell leukemias, adult T-cell leukemia/T-cell lymphomas and large granular lymphocytic leukemia, Langerhans cell histocytosis, myeloid neoplasias such as acute myelogenous leukemias, including AML with maturation, AML without differentiation, acute promyelocytic leukemia, acute myelomonocytic leukemia, and acute monocytic leukemias, myelodysplastic syndromes, and chronic myeloproliferative disorders, including chronic myelogenous leukemia; tumors of the central nervous system such as glioma, glioblastoma, neuroblastoma, astrocytoma, medulloblastoma, ependymoma, and retinoblastoma; solid tumors of the head and neck (e.g., nasopharyngeal cancer, salivary gland carcinoma, and esophageal cancer), lung (e.g., small-cell lung cancer, non-small cell lung cancer, adenocarcinoma of the lung and squamous carcinoma of the lung), digestive system (e.g., gastric or stomach cancer including gastrointestinal cancer, cancer of the bile duct or biliary tract, colon cancer, rectal cancer, colorectal cancer, and anal carcinoma), reproductive system (e.g., testicular, penile, or prostate cancer, uterine, vaginal, vulval, cervical, ovarian, and endometrial cancer), skin (e.g., melanoma, basal cell carcinoma, squamous cell cancer, actinic keratosis, cutaneous melanoma), liver (e.g., liver cancer, hepatic carcinoma, hepatocellular cancer, and hepatoma), bone (e.g., osteoclastoma, and osteolytic bone cancers) additional tissues and organs (e.g., pancreatic cancer, bladder cancer, kidney or renal cancer, thyroid cancer, breast cancer, cancer of the peritoneum, and Kaposi's sarcoma), tumors of the vascular system (e.g., angiosarcoma and hemangiopericytoma), Wilms' tumor, retinoblastoma, osteosarcoma and Ewing's sarcoma.

b. Non-Cancer Hyperproliferative Diseases

Any ADA2 described herein, such as a wildtype, variant, conjugate (e.g. PEGylated ADA2) or other modified form thereof, can be used to treat a non-cancer hyperproliferative disease in a subject. Adenosine and ADR signaling play a role in various signaling pathways that include G-protein-coupled receptors (GPCRs), cyclic AMP (cAMP) signaling, and/or cytokine signaling, to a variety of cellular responses such as mitogen activated protein kinase activation, gene transcription and proliferation. Activation of certain adenosine receptors (ADRs), such as the A1 receptor, can initiate cellular pathways leading to cellular proliferation. Overexpression and/or overstimulation can result in hyperproliferation. Any ADA2 provided herein can be used to treat non-cancer hyperproliferative disorders by reducing the activation of ADRs in cells involved in the hyperproliferative disorders.

Examples of hyperproliferative diseases that can be treated by any ADA2 provided herein, including wildtype, variants and modified forms thereof provided herein include any hyperproliferative diseases, including, for example, psoriasis, actinic keratoses, and seborrheic keratoses, warts, keloid scars, and eczema. Also included are hyperproliferative diseases caused by virus infections, such as papilloma virus infection. Different types of psoriasis can display characteristics such as pus-like blisters (pustular psoriasis), severe sloughing of the skin I (erythrodermic psoriasis), drop-like dots (guttae psoriasis) and smooth inflamed lesions (inverse psoriasis). It is understood that treatment of psoriasis includes treatment of all types of psoriasis (e.g., psoriasis vulgaris, psoriasis pustulosa, psoriasis erythrodermica, psoriasis arthropathica, parapsoriasis, palmoplantar pustulosis).

c. Fibrotic Diseases

Any ADA2 described herein, such as a wildtype, variant, conjugate (e.g. PEGylated ADA2) or other modified form thereof, can be used to treat fibrotic diseases, and particularly those associated with elevated adenosine. Adenosine levels are elevated in stressed conditions, such as hypoxia, ischemia, inflammation, tumor environment or trauma. In these conditions, extracellular adenosine works as a danger signal, and promotes various responses for tissue homeostasis. However, the persistence of increased adenosine concentrations beyond the acute-injury phase can become detrimental to tissues by activating pathways that trigger immune suppression or promote an unremitting wound-healing process, which leads to fibrotic remodeling (Antonioli et al. (2013) Nat Rev Can 13:842-857). Administration of ADA2 provided herein, which can reduce the stress-related increase in extracellular adenosine, can be used to treat diseases or conditions associated with excessive fibrotic tissue deposition, such as fibrosis, the formation of excess fibrous connective tissue in an organ or tissue in a reparative or reactive process. Diseases or conditions associated with fibrosis include, for example, fibrosis of the lungs, including Idiopathic pulmonary fibrosis and cystic fibrosis; fibrosis of the liver, including cirrhosis; fibrosis of the heart, including endomyocardial fibrosis, myocardial infarction, atrial fibrosis; and other fibrosis conditions, including mediastinal fibrosis (fibrosis of the soft tissue of the mediastinum), myelofibrosis (fibrosis of the bone marrow), retroperitoneal fibrosis (fibrosis of the soft tissue of the retroperitoneum), progressive massive fibrosis (fibrosis of the lungs), nephrogenic systemic fibrosis (fibrosis of the skin), Crohn's Disease (fibrosis of the intestine), keloid (fibrosis of the skin), scleroderma/systemic sclerosis (fibrosis of the skin, lungs), arthrofibrosis (fibrosis of the knee, shoulder, other joints), Peyronie's disease (fibrosis of the penis), Dupuytren's contracture (fibrosis of the hands, fingers), and adhesive capsulitis (fibrosis of the shoulder).

d. Infectious Diseases

Any ADA2 described herein, such as a wildtype, variant, conjugate (e.g. PEGylated ADA2) or other modified form thereof, can be used to treat infectious diseases associated with elevated adenosine. Invasive pathogens can take advantage of the host's endogenous immunosuppressive mechanisms, such as adenosine-mediated immunosuppression, to promote spread or survival within the host. For example, *Candida albicans* hyphae release adenosine to suppress the neutrophil-mediated killing of the organism, and *Staphylococcus aureus* also produce adenosine to suppress the host's immune response. In addition, increased susceptibility to infection in neonates and the elderly is also associated with elevated adenosine levels signaling (Hasko et al. (2013) Front Immunol. 4:85).

Therefore, in certain infectious diseases, ADA2 can be used as treatment to decrease the adenosine-mediated immunosuppression. Any ADA2 provided herein, including wildtype, variants and modified forms thereof, can be used to treat infectious diseases. Infectious diseases that can be treated by any ADA2 provided herein include, but are not limited to, diseases caused by pathogens such as viruses, bacteria, fungi, protozoa, and parasites. Infectious diseases can be caused by viruses including adenovirus, cytomegalovirus, dengue, Epstein-Barr, hanta, hepatitis A, hepatitis B, hepatitis C, herpes simplex type I, herpes simplex type II, human immunodeficiency virus, (HIV), human papilloma virus (HPV), influenza, measles, mumps, papova virus, polio, respiratory syncytial virus, rinderpest, rhinovirus, rotavirus, rubella, SARS virus, smallpox and viral meningitis. Infectious diseases can also be caused by bacteria including *Bacillus anthracis, Borrelia burgdorferi, Campylobacter jejuni, Chlamydia trachomatis, Clostridium botulinum, Clostridium tetani, Diphtheria, Escherichia coli, Legionella, Helicobacter pylori, Mycobacterium rickettsia, Mycobacterium tuberculosis, Mycoplasma Neisseria, Pertussis, Pseudomonas aeruginosa, Streptococcus pneumoniae, Streptococcus, Staphylococcus, Vibrio cholerae* and *Yersinia pestis*. Infectious diseases can also be caused by fungi such as *Aspergillus fumigatus, Blastomyces dermatitidis, Candida albicans, Coccidioides immitis, Cryptococcus neoformans, Histoplasma capsulatum* and *Penicillium marneffei*. Infectious diseases can also be caused by protozoa and parasites such as chlamydia, kokzidiose, leishmania, malaria, *rickettsia*, and *trypanosoma*.

e. Other Diseases and Conditions

Individuals who harbor deleterious mutations in the ADA1 gene can develop varying degrees of immunodeficiency disorder, from mild to severe. Such immunodeficiency disorder is due to the toxic accumulation of the enzyme substrates, adenosine and deoxyadenosine, in the immature lymphoid cells. The onset of the disorder can also range from early childhood to adults, depending on the mutations inherited. Deficiencies of ADA1 are one of the leading causes of severe combined immunodeficiency disease (SCID) in children and is one of the leading targets for gene therapy approaches (R. Parkman et al., 2000, "Gene therapy for adenosine deaminase deficiency," *Ann. Rev. Med.* 51:33-47).

An ADA2 provided herein, such as wildtype, variant, conjugate (e.g. PEGylated ADA2), or other modified forms, can be used in the treatment of SCID or other ADA1-mediated immunodeficiencies. Immunodeficiencies are generally categorized as either acquired immunodeficiencies or inherited immunodeficiencies. Acquired immunodeficiencies include human immunodeficiency virus-1 (HIV-1) infection, herpes virus infections, Epstein-Barr virus infections, lepromatous leprosy and diminished immune capacity resulting from skin burns in burn patients, i.e. burn-related immunodeficiency. Inherited immunodeficiencies include several genetically different forms of SCID, including adenosine deaminase deficiency dependent SCID (ADA SCID), SCID autosomal recessive with and without B cells (no ADA deficiency), SCID X-linked recessive without B cells, SCID autosomal recessive (with ADA deficiency), purine nucleotide phosphorylase deficiency (PNP SCID), severe combined immune deficiency (IL-2 receptor deficiency; i.e. X-linked SCID), and bare lymphocyte syndrome. Other immunodeficiencies include various forms of congenital or genetically determined hematopoietic abnormalities, several high risk leukemias and several forms of severe life-threatening aplastic anemia. Still other immunodeficiencies that can be treated include Wiskott-Aldrich syndrome; Blackfan-Diamond syndrome; Fanconi anemia; severe neutrophil dysfunction; chronic granulomatous disease of childhood; severe (Kostman-type) agranulocytosis; immunodeficiency and neutropenia of cartilage-hair hypoplasia; infantile and late onset osteoporosis; aplastic anemia-toxic chemical, idiopathic, immunological, and genetic (non-Fanconi); acute myeloid leukemia; chronic myeloid leukemia; Burkitt lymphoma, and recurrent acute lymphatic leukemia. In particular examples, the immune system disorder that is treated is adenosine deaminase deficiency-dependent severe combined immunodeficiency (ADA SCID).

2. Methods of Patient Selection

Provided herein are methods of patient selection for treatment with any ADA2 provided herein, based on the level of adenosine-associated biomarkers described herein.

Exemplary adenosine-associated biomarkers include plasma adenosine levels, adenosine receptor (ADR) levels and ectonucleotidase levels.

For example, subjects with elevated adenosine levels in the plasma or other samples, can be more responsive to treatment using ADA2, as the effects of ADA2 administration directly reduce the elevated extracellular adenosine levels. In another example, subjects that express elevated or high levels of ADRs, such as the A2A and A2B adenosine receptors in samples, such as tumor samples, can be more responsive to treatments using ADA2, as the effects on adenosine and tumor growth can be mediated directly by binding to ADRs expressed on tumor cells. In a further example, subjects with elevated levels or expression of the CD39 and CD73 ectonucleotidases in the tumor sample or other samples can be more responsive to treatment using ADA2, as the increased expression of CD39 and CD73 lead to elevated adenosine levels, and elevated adenosine levels, via signaling through the ADRs, have downstream cancer promoting effects. Thus, these biomarkers can be used to select or identify patients predicted to be responsive to treatment and/or to monitor treatment and efficacy of treatment, thereby providing an improved treatment regimen of adenosine-associated diseases or conditions, such as a tumor or a cancer, using any ADA2 provided herein.

a. Adenosine-Associated Biomarkers

Provided herein are methods of selecting patients that have tumors in which treatment with ADA2 is applicable. The methods provided herein are applicable to treating conditions and diseases that are associated with elevated adenosine levels and/or susceptible to a reduction in adenosine or deoxyadenosine levels in the subject to be treated. For example, such conditions or diseases include a tumor or a cancer. Levels of adenosine-associated biomarkers, such as plasma adenosine levels, adenosine receptor (ADR) levels and ectonucleotidase levels, can be used for diagnosis or prognosis of an adenosine-associated disease or condition, to predict responsiveness of a subject having an adenosine-associated disease or condition to any ADA2 or combination therapy provided herein, and/or to monitor or predict efficacy of treatment of a subject having an adenosine-associated disease or condition that has been treated with an ADA2 provided herein, including wildtype, variants and modified forms thereof.

In any examples provided herein, the adenosine-associated diseases or conditions are diseases and conditions in which adenosine levels are elevated as cause, consequence or otherwise observed in the disease or condition. Exemplary adenosine-associated diseases or conditions, include, but are not limited to, a cancer, a tumor, an inflammatory disease, an infection, and other conditions and diseases associated with elevated adenosine levels and/or is susceptible to a reduction in adenosine or deoxyadenosine levels in the subject to be treated. In particular, adenosine-associated diseases and conditions, include, but are not limited to, cancers with elevated adenosine levels in the extracellular environment, for example, tumors, including solid tumors that are hypoxic. Provided herein are methods of treatment that includes measurement of adenosine-associated biomarkers and selection of subjects for treatment with any ADA2 provided herein.

i. Plasma Adenosine Levels

In one example, a patient or subject can be selected for treatment with any ADA2 provided herein, based on the levels or expression of extracellular adenosine in the sample, such as the plasma. In other examples, the level of extracellular adenosine in the tumor microenvironment of a specific tumor can be used. Plasma adenosine level can be measured using any methods known in the art, including chromatography-based methods. It is within the level of one of skill in the art to assess, quantify, determine and/or detect adenosine levels in a plasma sample using assays known in the art. Assays include in vitro or in vivo assays. Exemplary assays that can be used to assess, evaluate, determine, quantify and/or otherwise specifically detect adenosine levels in a sample include, but are not limited to, high performance liquid chromatography (HPLC)-based assays (see, e.g., Jackson and Ohnishi (1987) Hypertension 10:189-197), spectrophotometric methods, radioenzymatic assays (see, e.g., German and Kredich (1984) Anal Biochem. 142(2): 536-541), microelectrode-based detection, and in vivo imaging methods, such as bioluminescence-based methods. In some examples, plasma adenosine levels can be detected using a modified HPLC method that utilizes a reaction that converts adenosine into a fluorescent derivative, such as 1,N6-ethanoadenosine for detection of adenosine levels. (Howard et al. (1998) Investigative Opthalmology & Visual Science, 39(10):1942-1946).

ii. Adenosine Receptors (ADRs)

The level of expression of adenosine receptors (ADRs) can be used as biomarkers for the selection of patients or subjects for treatment with any ADA2 provided herein. In particular, ADRs that are expressed in tumor cells and/or immune cells involved in tumor immunity, such as the A2A (amino acid sequence set forth in SEQ ID NO:534) and A2B (amino acid sequence set forth in SEQ ID NO:535) adenosine receptors, can be used. Tumors that express elevated or high levels of ADRs, such as the A2A and A2B adenosine receptors, can be more responsive to treatments using ADA2, as the effects on adenosine and tumor growth can be mediated by adenosine binding to ADRs expressed on tumor cells. Some tumors have elevated expression of ADRs, in particular, A2A and A2B, and the expression of these receptors have downstream cancer-promoting effects. In other examples, adenosine signaling, through the stimulation of A2A and A2B receptors, regulate endothelial inflammatory processes and tumor angiogenesis. In other examples, expression of ADRs, such as the A2A and A2B adenosine receptors, have inhibitory effects on activation and differentiation of immune cells, such as macrophages and dendritic cells. Therefore, measurements of ADRs, such as the A2A and A2B adenosine receptors can be used to select tumors, including cancers, that are associated with elevated adenosine levels and/or susceptible to a reduction in adenosine or deoxyadenosine levels. Levels of ADRs, such as the A2A and A2B adenosine receptors, can be used to select or identify patients predicted to be responsive to treatment and/or to monitor treatment and efficacy of treatment, thereby providing an improved treatment regimen of adenosine-associated diseases or conditions, such as a tumor or a cancer.

For example, a patient or subject can be selected for treatment with any ADA2 provided herein, based on the levels or expression of the A2A and A2B adenosine receptors in a sample, such as a tumor or fluid sample from a subject having a tumor or suspected of having a tumor. Level of expression of ADRs, for example, the A2A and A2B adenosine receptors, can be measured using any methods known in the art for determining levels of extracellular receptors on a cell. It is within the level of one of skill in the art to assess, quantify, determine and/or detect levels of ADRs, such as those of A2A and A2B adenosine receptors, in a sample using assays known in the art. Assays include in vitro or in vivo assays. Exemplary assays that can be used to assess, evaluate, determine, quantify and/or otherwise specifically detect levels of ADRs, such as those of A2A and A2B adenosine receptors, in a sample include, but are not limited to, solid phase binding assays (e.g. enzyme linked immunosorbant assay (ELISA)), radioimmunoassay (RIA), immunoradiometric assay, fluorescence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used.

The methods provided herein are directed to measurement of ADR protein levels, such as that of the A2A and A2B adenosine receptors, in a sample, such as a tumor or fluid sample from a subject having a tumor or suspected of having a tumor, using antibodies against ADRs, such as the A2A and A2B adenosine receptors. Exemplary antibodies against adenosine receptor A2A include those from Santa Cruz Biotechnology (Dallas, Tex.; Cat no. sc-70321), Abcam (Cambridge, UK; Cat no. ab3461), and EMD Milipore (Billerica, Mass.; Cat no. AB1559P). Exemplary antibodies against adenosine receptor A2B include those from Santa Cruz Biotechnology (Dallas, Tex.; Cat no. sc-7505), Abcam (Cambridge, UK; Cat no. ab40002), and EMD Milipore (Billerica, Mass.; Cat no. AB1589P). The antibodies can be used to detect the ADR protein levels in samples, using methods such as immunohistochemistry, ELISA, RIA, immunoradiometric assay, fluorescence assay, chemiluminescent assay, bioluminescent assay, and western blot. The antibodies can be modified by conjugation, directly or indirectly, to biotin, a fluorescent moiety, a radiolabel or other detectable label. In other examples, secondary antibodies, which are conjugated to a detectable label, can be used.

ADR levels, such as that of the A2A and A2B adenosine receptors, can also be determined using in vivo imaging methods. For example, positron emission tomography (PET) with the administration of xanthine derivatives, which have A2A receptor antagonist activity, radiolabeled with the positron emitter carbon-11 ($^{11}$C), such as $^{11}$C-SCH442416, $^{11}$C-KF1783, $^{11}$C-KF18446, $^{11}$C-KF19631, $^{11}$C-KW-6002 and $^{11}$C-TMSX (Grachev et al. (2014) Journal of Diagnostic Imaging in Therapy 1(1):1-19).

Other methods of determining ADR levels, such as that of the A2A and A2B adenosine receptors, include nucleic acid based methods, such as reverse transcriptase-polymerase chain reaction (RT-PCR), microarrays, quantitative PCR, high-throughput transcriptome sequencing, and other such methods.

iii. Ectonucleotidases CD39 and CD73

The level of expression of ectonucleotidases CD39 and CD73 that are expressed in tumor cells can be used as biomarkers for the selection of patients or subjects for treatment with any ADA2 provided herein. CD39 and CD73 are the ectonucleotidases that generate extracellular adenosine from adenosine triphosphate (ATP). CD39 (Ectonucleoside triphosphate diphosphohydrolase 1; EC 3.6.1.5; amino acid sequence set forth in SEQ ID NO:542) metabolizes extracellular ATP to generate adenosine diphosphate (ADP) and adenosine monophosphate (AMP), and CD73 (ecto-5'-nucleotidase; EC 3.1.3.5; amino acid sequence set forth in SEQ ID NO:543) metabolizes AMP to generate adenosine. CD39 and CD73 are the major source of extracellular adenosine during conditions associated with a rapid elevation of adenosine levels, such as hypoxia, ischemia, inflammation, tumor environment or trauma. In these conditions, extracellular ATP increases, which leads to a subsequent increase in adenosine levels, by the action of CD39 and CD73 ectonucleotidases. In certain cancer types, the level of CD39 and CD73 are overexpressed, and elevated CD73 levels are associated with poor prognosis and high early tumor recurrence. Thus, the level of expression of ectonucleotidases CD39 and CD73 can be used as a biomarker for tumors associated with elevated adenosine levels and for selection of patients for treatment with any ADA2 provided herein.

For example, a patient or subject can be selected for treatment with any ADA2 provided herein, based on the levels or expression of the CD39 and CD73 ectonucleotidases in a sample, such as a tumor or fluid sample from a subject having a tumor or suspected of having a tumor, or immune cells. Level of expression of CD39 and CD73 ectonucleotidases can be measured using any methods known in the art for determining levels of plasma membrane or extracellular proteins. It is within the level of one of skill in the art to assess, quantify, determine and/or detect the level of expression CD39 and CD73 ectonucleotidases in a sample using assays known in the art. Assays include in vitro or in vivo assays. Exemplary assays that can be used to assess, evaluate, determine, quantify and/or otherwise specifically detect the level of expression CD39 and CD73 ectonucleotidases in a sample include, but are not limited to, solid phase binding assays (e.g. enzyme linked immunosorbant assay (ELISA)), radioimmunoassay (RIA), immunoradiometric assay, fluorescence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used.

The methods provided herein are directed to measurement of CD39 and CD73 ectonucleotidases in a sample, such as a tumor or fluid sample from a subject having a tumor or suspected of having a tumor, using antibodies against CD39 and CD73 ectonucleotidases. Exemplary antibodies against CD39 include those from Santa Cruz Biotechnology (Dallas, Tex.; Cat no. sc-65262), Abcam (Cambridge, UK; Cat no. ab49580), and EMD Milipore (Billerica, Mass.; Cat no. 04-973). Exemplary antibodies against CD73 include those from Santa Cruz Biotechnology (Dallas, Tex.; Cat no. sc-8502), Abcam (Cambridge, UK; Cat no. ab4056), and EMD Milipore (Billerica, Mass.; Cat no. IHCR2023-6). The antibodies can be used to detect the ADR protein levels in samples, using methods such as immunohistochemistry, ELISA, RIA, immunoradiometric assay, fluorescence assay, chemiluminescent assay, bioluminescent assay, and western blot. The antibodies can be modified by conjugation, directly or indirectly, to biotin, a fluorescent moiety, a radiolabel or other detectable label. In other examples, secondary antibodies, which are conjugated to a detectable label, can be used.

Other methods of determining CD39 and CD73 ectonucleotidase levels include nucleic acid based methods, such as reverse transcriptase-polymerase chain reaction (RT-PCR), microarrays, quantitative PCR, high-throughput transcriptome sequencing, and other such methods.

b. Patient Selection

Once the amount of the level of biomarkers, such as plasma adenosine levels, levels of ADRs such as A2A or A2B, or levels of CD39 and CD73 ectonucleotidases, is determined the amount can be compared to a control or threshold level. The control or threshold level is generally a predetermined threshold level or amount that is indicative of disease or condition associated with elevated adenosine levels (e.g. a tumor or cancer). Such level or amount can be empirically determined by one of skill in the art. It is understood that the particular predetermined selection or classification criteria for the methods herein are dependent on the particular assay that is used to detect the level of adenosine-associated biomarkers and the particular sample that is being tested. It is within the level of one of skill in the art to determine if an assay is compatible with testing a particular sample. In vitro solid phase assays or high performance liquid chromatography (HPLC) based assays can be used for testing body fluid samples. Assays such as histochemistry or immunohistochemistry can be used for testing tissue samples. It also is understood that in methods involving comparisons to a predetermined level or amount or to a control or reference sample that the references are made with the same type of sample and using the same assay and reagents (including the same detectable moiety and detection method).

For example, the predetermined threshold level can be determined based on the level or amount of the marker in a reference or control sample, such as the median or mean level or amount of the marker in a population of subjects, in order to assess differences in levels or expression. In one example, the predetermined threshold level can represent the mean or median level or amount of the adenosine-associated biomarker in a sample from a healthy subject or a subject known to have a condition or disease associated with elevated adenosine levels (e.g. a tumor or cancer). In one embodiment, the predetermined level or amount of the adenosine-associated biomarker from a normal tissue or bodily fluid sample is the mean level or amount observed in normal samples (e.g., all normal samples analyzed). In another embodiment, the level or amount of the adenosine-associated biomarker from a normal tissue or bodily fluid sample is the median value for the level or amount observed in normal samples. The predetermined threshold level also can be based on the level or amount of the adenosine-associated biomarker in a cell line or other control sample (e.g. tumor cell line). As described herein, these predetermined values can be determined by comparison or knowledge of the adenosine-associated biomarker levels in a corresponding normal sample as determined by the same assay of detection and using the same reagents, for example, the same antibody and detection method.

The reference or control sample can be another tissue, cell or body fluid, such as a normal tissue, cell or body fluid, for example, a tissue, cell or body fluid that is analogous to the sample being tested, but isolated from a different subject. The control or reference subject can be a subject or a population of subjects that is normal (i.e. does not have a disease or condition), a subject that has a disease but does not have the type of disease or condition that the subject being tested has or is suspected of having, for example, a subject that does not have a condition or disease associated with elevated adenosine levels (e.g. a tumor or cancer), or an analogous tissue from another subject that has a similar disease or condition, but whose disease is not as severe and/or expresses relatively less of the adenosine-associated biomarker. For example, when the cell, tissue or fluid being tested is a subject or a population of subjects having a cancer, the level or amount of the marker can be compared to the level or amount of the marker in a tissue, cell or fluid from a subject having a less severe cancer, such as an early stage, differentiated or other type of cancer. In another example, a control or reference sample is a fluid, tissue, extract (e.g. cellular or nuclear extract), nucleic acid or peptide preparation, cell line, biopsy, standard or other sample, with a known amount or relative amount of the adenosine-associated biomarker, such as a sample, for example a tumor cell line or tumors from tumor models generated using such cell lines.

In any method herein, the level(s) of the adenosine-associated biomarker in samples from subjects suspected or known to have a condition or disease associated with elevated adenosine levels (e.g., cancer) can be determined concurrently with the determination of level(s) of the adenosine-associated biomarker in reference or normal tissues. Alternatively, the levels of the adenosine-associated biomarker in samples from subjects suspected or known to have a condition or disease associated with elevated adenosine levels (e.g. cancer) can be compared to the level(s) of the adenosine-associated biomarker previously determined in normal tissue or bodily fluid. Thus, the level of the adenosine-associated biomarker in normal or healthy samples or other reference samples employed in any detection, comparison, determination, or evaluation can be a level or amount determined prior to any detection, determination, or evaluation of the level or amount of the adenosine-associated biomarker in a sample from a human patient.

The level or amount of the adenosine-associated biomarker of is determined and/or scored and compared to predetermined phenotypes of the adenosine-associated biomarker associated with disease. It is within the level of one of skill in the art to determine the threshold level for disease diagnosis depending on the particular disease, the assay being used for detection of the adenosine-associated biomarker and/or the detection reagent being used. It is within the level of one of skill in the art to determine the threshold level of the adenosine-associated biomarker for classifying responsiveness to treatment with any ADA2 provided herein. Exemplary methods for stratification of tumor samples or bodily fluid samples for diagnosis, prognosis or selection of subjects for treatment are provided herein.

It is understood that the particular change, e.g. increase in or decrease of the adenosine-associated biomarker is dependent on the assay used. In an ELISA, the fold increase or decrease in absorbance at a particular wavelength or in quantity of protein (e.g. as determined by using a standard curve) can be expressed relative to a control. In a PCR assay, such as RT-PCR, expression levels can be compared to control expression levels (e.g. expressed as fold change) using methods known to those in the art, such as using standards.

In particular examples of the methods herein, a subject is selected as a candidate for therapy with any ADA2 provided herein, if the amount of the adenosine-associated biomarker is determined to be elevated in the sample. For example, elevated or accumulated adenosine-associated biomarker levels in a diseased subject compared to a healthy or normal subject is indicative of a condition or disease associated with elevated adenosine levels (e.g. tumor or cancer). The adenosine-associated biomarker can be elevated 0.5-fold, 1-fold, 2-fold, 3-fold, 4-fold, 5-fold, 6-fold, 7-fold, 8-fold, 9-fold, 10-fold, 15-fold, 20-fold, 30-fold, 40-fold, 50-fold, 60-fold, 70-fold, 80-fold, 90-fold, 100-fold, 150-fold, 200-fold, 500-fold, 1000-fold or more. Thus, in examples of the methods herein, when the amount of the adenosine-associated biomarker in a sample from a subject is being tested, detection of the marker can be determining that the amount of the adenosine-associated biomarker in the sample (e.g.

cancerous cell, tissue or fluid) from the subject is elevated compared to a predetermined level or amount or control sample. In one example, the subject is determined to have a condition or disease associated with elevated adenosine levels if the amount of the adenosine-associated biomarker in the tissue, cell or fluid is elevated at or about 0.5-fold, 1-fold, 2-fold, 3-fold, 4-fold, 5-fold, 6-fold, 7-fold, 8-fold, 9-fold, 10-fold, 15-fold, 20-fold, 30-fold, 40-fold, 50-fold, 60-fold, 70-fold, 80-fold, 90-fold, 100-fold, 150-fold, 200-fold, 500-fold, 1000-fold or more, compared to the predetermined level or amount or control sample.

A subject can be selected as a candidate for therapy with any ADA2 provided herein, including wildtype, variants and modified forms thereof, based on the level or amount of adenosine levels in a sample (e.g. plasma) from the subject. For example, plasma adenosine levels greater than 0.1 mM, such as 0.1 mM, 0.2 mM, 0.3 mM, 0.4 mM, 0.5 mM, 0.6 mM, 0.7 mM, 0.8 mM, 0.9 mM, 1 mM, 2 mM, 3 mM, 4 mM, 5 mM, 6 mM, 7 mM, 8 mM, 9 mM, 10 mM or higher, correlates to the presence of a tumor or cancer. Using such methods, in exemplary methods provided herein, a subject can be selected for treatment with any ADA2 provided herein if the adenosine level in the fluid sample, such as a plasma sample, is greater than 0.1 mM, such as 0.1 mM, 0.2 mM, 0.3 mM, 0.4 mM, 0.5 mM, 0.6 mM, 0.7 mM, 0.8 mM, 0.9 mM, 1 mM, 2 mM, 3 mM, 4 mM, 5 mM, 6 mM, 7 mM, 8 mM, 9 mM, 10 mM or higher.

A subject can be selected as a candidate for therapy with any ADA2 provided herein, based on the level or amount of the adenosine-associated biomarker, such as ADRs, such as the A2A (SEQ ID NO:534) and A2B (SEQ ID NO:535) adenosine receptors or CD39 (SEQ ID NO:542) and CD73 (SEQ ID NO:543) ectonucleotidases, in a cell or tissue sample. In such an example, if the level is indicative of disease, then the patient is diagnosed with a condition or disease associated with elevated adenosine levels. For example, a high percentage of staining indicates the subject has a tumor with elevated the adenosine-associated biomarker, such as ADRs, such as the A2A and A2B adenosine receptors or CD39 and CD73 ectonucleotidase, indicative of the presence of a tumor that would benefit from treatment with any ADA2 provided herein and thus is a candidate for treatment with any ADA2 provided herein. In other examples, a subject can be selected for treatment with any ADA2 provided herein, based on the percentage of staining, for example, if the degree of the adenosine-associated biomarker staining is 10%, 15%, 20%, 25%, 30%, 35%, 40%, 45%, 50%, 55%, 60%, 65%, 70%, 75%, 80%, 85%, 90%, 95% or more of the total staining area, and generally at least 25% or more. Using histochemical methods, the amount of the adenosine-associated biomarker detected is quantified and given as a percentage of the adenosine-associated biomarker positive pixels and/or a score. For example, the amount of the adenosine-associated biomarker detected in the sample can be quantified as a percentage of the adenosine-associated biomarker positive pixels. In some examples, the amount of the adenosine-associated biomarker present in a sample is quantified as the percentage of area stained, e.g., the percentage of the adenosine-associated biomarker positive pixels. For example, a sample can have at least or at least about or about 0, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 40%, 45%, 50%, 55%, 60%, 65%, 70%, 75%, 80%, 85%, 90%, 95% or more of the adenosine-associated biomarker positive pixels as compared to the total staining area.

Efficacy of treatment with any ADA2 provided herein or responsiveness to treatment also can be monitored by comparing the level or amount of adenosine-associated biomarkers in a subject over time. Changes in the level or amount of adenosine-associated biomarkers can be used to optimize dosing or scheduling of treatment with any ADA2 provided herein. In the method, the level of adenosine-associated biomarkers in samples, from treated subjects, are compared to a predetermined level of adenosine-associated biomarkers.

For purposes of monitoring treatment, the predetermined level of the adenosine-associated biomarker can be from a normal or healthy subject, a baseline adenosine-associated biomarker value prior to treatment, the prior measured adenosine-associated biomarker level in the same subject at an earlier time after treatment, or a classification or stratification of the adenosine-associated biomarker levels known to be associated with disease progression or regression. For example, if the adenosine-associated biomarker level is about the same as or below (or decreased) as compared reference or control sample, the treatment is indicated to be efficacious and the treatment can be continued or discontinued or altered. For example, the predetermined level of the adenosine-associated biomarker can be an adenosine-associated biomarker level from a normal or healthy tissue sample, and if the level of the adenosine-associated biomarker measured in the subject after treatment is higher than the normal the adenosine-associated biomarker levels, then treatment is resumed or continued. For example, the predetermined level of the adenosine-associated biomarker can be the adenosine-associated biomarker levels as determined from a baseline adenosine-associated biomarker value prior to treatment, and the course of treatment determined accordingly. For example, if the level of the adenosine-associated biomarker is the same as baseline levels, then treatment is continued or resumed; if the level of the adenosine-associated biomarker is higher than baseline levels, then treatment is continued or resumed or treatment is accelerated or increased (e.g. by increasing the dosage of ADA2 or increasing the dose schedule in a dosage regimen cycle); if the level of the adenosine-associated biomarker is less than baseline levels, then treatment is continued or resumed, terminated or is reduced or decreased (e.g. by decreasing the dosage of ADA2 or decreasing the dose schedule in a dosage regimen cycle). In a further example, the predetermined level of the adenosine-associated biomarker can be an adenosine-associated biomarker level as determined in a prior measurement in an earlier course of treatment of the same subject. For example, if the level of the adenosine-associated biomarker is the same as the earlier measured levels, then treatment is continued or resumed; if the level of the adenosine-associated biomarker is higher than the earlier measured levels, then treatment is continued or resumed or treatment is accelerated or increased (e.g. by increasing the dosage of ADA2 or increasing the dose schedule in a dosage regimen cycle); if the level of the adenosine-associated biomarker is less than the earlier measured levels, then treatment is continued or resumed, terminated or is reduced or decreased (e.g. by decreasing the dosage of ADA2 or decreasing the dose schedule in a dosage regimen cycle).

In the monitoring methods or methods of determining efficacy of treatment, the particular therapy can be altered during the course of treatment to maximize individual response. Dosing and scheduling of treatment can be modified in response to changing levels. Combination therapy using other therapeutic agents, such as other anti-cancer agents, also can be employed in such treatment methods. It is within the level of the skill of the treating physician to determine the exact course of treatment. For example, the treatment can be altered, such that the dosing amount, schedule (e.g frequency of administration), or regime is adjusted accordingly, such as discontinued, decreased or made less frequent, or combined with another treatment for the disease or condition. On the other hand, if the adenosine-associated biomarker level is above a compared reference or control sample, the patient is indicated to be not responding to the treatment. In such instances, the particular nature and type of the therapeutic agent, such as ADA2 or combination therapy can be modified or changed. In other instances, the dosing, amount, schedule and/or regime can be adjusted accordingly, such as increased or made more frequent. It is within the level of the treating physician to determine the exact course of treatment.

For purposes of monitoring efficacy of treatment, predetermined levels or amounts of the adenosine-associated biomarker can be empirically determined, whereby the level or amount indicates that the treatment is working. These predetermined values can be determined by comparison or knowledge of the adenosine-associated biomarker levels in a corresponding normal sample or samples of disease subjects as determined by the same assay of detection and using the same reagent. For example, high levels of the adenosine-associated biomarker as assessed by immunohistochemistry methods using a quantitative score scheme or percentage of tumor staining for the adenosine-associated biomarker of greater than 25% correlate to the existence of malignant disease across a range of cancer types, and indicate that a patient is not responding to treatment.

In the methods herein, the comparison to a predetermined level or to levels of a control or reference sample can be determined by any method known of skill in the art. For example, the comparison of the level of the adenosine-associated biomarker with a reference, control or predetermined level can be done by an automated system, such as software program or intelligence system that is part of, or compatible with, the equipment (e.g. computer platform) on which the assay is carried out. Alternatively, this comparison can be done by a physician or other trained or experienced professional or technician.

3. Dosages and Administration

Any ADA2 provided herein, including wildtype, variants and modified forms thereof, can be formulated as pharmaceutical compositions for single dosage or multiple dosage administration. The ADA2 polypeptide is included in the composition in an amount sufficient to exert a therapeutically useful effect in the absence of undesirable side effects on the patient treated. The therapeutically effective concentration can be determined empirically by testing the polypeptides in known in vitro and in vivo systems such as by using the assays provided herein or known in the art (see e.g., Taliani et al. (1996) *Anal. Biochem.*, 240: 60-67; Filocamo et al. (1997) *J Virology*, 71: 1417-1427; Sudo et al. (1996) *Antiviral Res.* 32: 9-18; Bouffard et al. (1995) *Virology*, 209:52-59; Bianchi et al. (1996) *Anal. Biochem.*, 237: 239-244; Hamatake et al. (1996) *Intervirology* 39:249-258; Steinkuhler et al. (1998) *Biochem.*, 37:8899-8905; D'Souza et al. (1995) *J Gen. Virol.*, 76:1729-1736; Takeshita et al. (1997) *Anal. Biochem.*, 247:242-246; see also e.g., Shimizu et al. (1994) *J. Virol.* 68:8406-8408; Mizutani et al. (1996) *J. Virol.* 70:7219-7223; Mizutani et al. (1996) *Biochem. Biophys. Res. Commun.*, 227:822-826; Lu et al. (1996) *Proc. Natl. Acad. Sci.*, 93:1412-1417; Hahm et al., (1996) *Virology*, 226:318-326; Ito et al. (1996) *J Gen. Virol.*, 77:1043-1054; Mizutani et al. (1995) *Biochem. Biophys. Res. Commun.*, 212:906-911; Cho et al. (1997) *J. Virol. Meth.* 65:201-207) and then extrapolated therefrom for dosages for humans.

The amount of any ADA2 provided herein to be administered for the treatment of a disease or condition can be determined by standard clinical techniques. In addition, in vitro assays and animal models can be employed to help identify optimal dosage ranges. The precise dosage, which can be determined empirically, can depend on the particular agent, the route of administration, the type of disease to be treated and the seriousness of the disease. In some embodiments, the compositions administered can contain nucleic acids that encode the variant ADA2 polypeptide provided herein, such as oncolytic viral vectors or gene therapy vectors, or cells, such as modified immune cells for adoptive immunotherapy. Particular dosage can depend on the particular route of administration, the particular disease or condition, the severity of the disease or condition, the particular formulation and other factors within the level of a skilled artisan.

Hence, it is understood that the precise dosage and duration of treatment is a function of the disease being treated and can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

One of skill in the art can, in a clinical setting, determine the individual dosage of ADA2 provided herein for administration, depending on the clinical response of the tumor and the side effect profile of an individual subject, such as a human or an animal. For example, compositions of PEGylated ADA2 provided herein, can be formulated at 25 U/mL. If a 25 g mouse is injected with 0.2 mL of this formulation, this would translate into 200 U/kg body weight. One of skill in the art can determine the human equivalent dose (HED), based on body surface area, of approximately 16 U/kg body weight for humans. Appropriate HED can be calculated using body surface area or body weight-based conversion (Reagan-Shaw et al. (2008) The FASEB Journal 22(3):659-661).

The range of doses of any ADA2 provided herein can be from or from about 10 mU/kg body weight to about 50 U/kg body weight or higher. For example, a single dose can be 10 mU/kg body weight, 10 mU/kg, 20 mU/kg, 30 mU/kg, 40 mU/kg, 50 mU/kg, 60 mU/kg, 70 mU/kg, 80 mU/kg, 90 mU/kg, 100 mU/kg, 200 mU/kg, 300 mU/kg, 400 mU/kg, 500 mU/kg, 600 mU/kg, 700 mU/kg, 800 mU/kg, 900 mU/kg, 1 U/kg, 2 U/kg, 3 U/kg, 4 U/kg, 5 U/kg, 6 U/kg, 7 U/kg, 8 U/kg, 9 U/kg, 10 U/kg, 20 U/kg, 30 U/kg, 40 U/kg, or 50 U/kg body weight. In other examples, a single dose can be between or between about 10 mU/kg body weight and 50 U/kg body weight, 10 mU/kg and 40 U/kg, 10 mU/kg and 30 U/kg, 10 mU/kg and 20 U/kg, 10 mU/kg and 10 U/kg, 10 mU/kg and 9 U/kg, 10 mU/kg and 8 U/kg, 10 mU/kg and 7 U/kg, 10 mU/kg and 6 U/kg, 10 mU/kg and 5 U/kg, 10 mU/kg and 4 U/kg, 10 mU/kg and 3 U/kg, 10 mU/kg and 2 U/kg, 10 mU/kg and 1 U/kg, 10 mU/kg and 900 mU/kg, 10 mU/kg and 800 mU/kg, 10 mU/kg and 700 mU/kg, 10 mU/kg and 600 mU/kg, 10 mU/kg and 500 mU/kg, 10 mU/kg and 400 mU/kg, 10 mU/kg and 300 mU/kg, 10 mU/kg and 200 mU/kg, 10 mU/kg and 100 mU/kg, 100 mU/kg and 50 U/kg, 100 mU/kg and 40 U/kg, 100 mU/kg and 30 U/kg, 100 mU/kg and 20 U/kg, 100 mU/kg and 10 U/kg, 100 mU/kg and 9 U/kg, 100 mU/kg and 8 U/kg, 100 mU/kg and 7 U/kg, 100 mU/kg and 6 U/kg, 100 mU/kg and 5 U/kg, 100 mU/kg and 4 U/kg, 100 mU/kg and 3 U/kg, 100 mU/kg and 2 U/kg, 100 mU/kg and 1 U/kg, 100 mU/kg and 900 mU/kg, 100 mU/kg and 800 mU/kg, 100 mU/kg and 700 mU/kg, 100 mU/kg and 600 mU/kg, 100 mU/kg and 500 mU/kg, 100 mU/kg and 400 mU/kg, 100 mU/kg and 300 mU/kg, 100 mU/kg and 200 mU/kg, 500 mU/kg and 50 U/kg, 500 mU/kg and 40 U/kg, 500 mU/kg and 30 U/kg, 500 mU/kg and 20 U/kg, 500 mU/kg and 10 U/kg, 500 mU/kg and 9 U/kg, 500 mU/kg and 8 U/kg, 500 mU/kg and 7 U/kg, 500 mU/kg and 6 U/kg, 500 mU/kg and 5 U/kg, 500 mU/kg and 4 U/kg, 500 mU/kg and 3 U/kg, 500 mU/kg and 2 U/kg, 500 mU/kg and 1 U/kg, 500 mU/kg and 900 mU/kg, 500 mU/kg and 800 mU/kg, 500 mU/kg and 700 mU/kg, 500 mU/kg and 600 mU/kg, 1 U/kg and 50 U/kg, 1 U/kg and 40 U/kg, 1 U/kg and 30 U/kg, 1 U/kg and 20 U/kg, 1 U/kg and 10 U/kg, 1 U/kg and 9 U/kg, 1 U/kg and 8 U/kg, 1 U/kg and 7 U/kg, 1 U/kg and 6 U/kg, 1 U/kg and 5 U/kg, 1 U/kg and 4 U/kg, 1 U/kg and 3 U/kg, 1 U/kg and 2 U/kg, 5 U/kg and 50 U/kg, 5 U/kg and 40 U/kg, 5 U/kg and 30 U/kg, 5 U/kg and 20 U/kg, 5 U/kg and 10 U/kg, 5 U/kg and 9 U/kg, 5 U/kg and 8 U/kg, 5 U/kg and 7 U/kg, 5 U/kg and 6 U/kg, 10 U/kg and 50 U/kg, 10 U/kg and 40 U/kg, 10 U/kg and 30 U/kg, and 10 U/kg body weight and 20 U/kg body weight.

In another example, the range of doses of any ADA2 provided herein can be between or between about 0.1 mg/kg body weight and 50 mg/kg body weight, 0.1 mg/kg and 40 mg/kg, 0.1 mg/kg and 30 mg/kg, 0.1 mg/kg and 20 mg/kg, 0.1 mg/kg and 10 mg/kg, 0.1 mg/kg and 9 mg/kg, 0.1 mg/kg and 8 mg/kg, 0.1 mg/kg and 7 mg/kg, 0.1 mg/kg and 6 mg/kg, 0.1 mg/kg and 5 mg/kg, 0.1 mg/kg and 4 mg/kg, 0.1 mg/kg and 3 mg/kg, 0.1 mg/kg and 2 mg/kg, 0.1 mg/kg and 1 mg/kg, 0.1 mg/kg and 0.9 mg/kg, 0.1 mg/kg and 0.8 mg/kg, 0.1 mg/kg and 0.7 mg/kg, 0.1 mg/kg and 0.6 mg/kg, 0.1 mg/kg and 0.5 mg/kg, 0.1 mg/kg and 0.4 mg/kg, 0.1 mg/kg and 0.3 mg/kg, 0.1 mg/kg and 0.2 mg/kg, 0.5 mg/kg and 50 mg/kg, 0.5 mg/kg and 40 mg/kg, 0.5 mg/kg and 30 mg/kg, 0.5 mg/kg and 20 mg/kg, 0.5 mg/kg and 10 mg/kg, 0.5 mg/kg and 9 mg/kg, 0.5 mg/kg and 8 mg/kg, 0.5 mg/kg and 7 mg/kg, 0.5 mg/kg and 6 mg/kg, 0.5 mg/kg and 5 mg/kg, 0.5 mg/kg and 4 mg/kg, 0.5 mg/kg and 3 mg/kg, 0.5 mg/kg and 2 mg/kg, 0.5 mg/kg and 1 mg/kg, 0.5 mg/kg and 0.9 mg/kg, 0.5 mg/kg and 0.8 mg/kg, 0.5 mg/kg and 0.7 mg/kg, 0.5 mg/kg and 0.6 mg/kg, 1 mg/kg and 50 mg/kg, 1 mg/kg and 40 mg/kg, 1 mg/kg and 30 mg/kg, 1 mg/kg and 20 mg/kg, 1 mg/kg and 10 mg/kg, 1 mg/kg and 9 mg/kg, 1 mg/kg and 8 mg/kg, 1 mg/kg and 7 mg/kg, 1 mg/kg and 6 mg/kg, 1 mg/kg and 5 mg/kg, 1 mg/kg and 4 mg/kg, 1 mg/kg and 3 mg/kg, 1 mg/kg and 2 mg/kg, 2 mg/kg and 50 mg/kg, 2 mg/kg and 40 mg/kg, 2 mg/kg and 30 mg/kg, 2 mg/kg and 20 mg/kg, 2 mg/kg and 10 mg/kg, 2 mg/kg and 9 mg/kg, 2 mg/kg and 8 mg/kg, 2 mg/kg and 7 mg/kg, 2 mg/kg and 6 mg/kg, 2 mg/kg and 5 mg/kg, 2 mg/kg and 4 mg/kg, 2 mg/kg and 3 mg/kg, 5 mg/kg and 50 mg/kg, 5 mg/kg and 40 mg/kg, 5 mg/kg and 30 mg/kg, 5 mg/kg and 20 mg/kg, 5 mg/kg and 10 mg/kg, 5 mg/kg and 9 mg/kg, 5 mg/kg and 8 mg/kg, 5 mg/kg and 7 mg/kg, 5 mg/kg and 6 mg/kg, 10 mg/kg and 50 mg/kg, 10 mg/kg and 40 mg/kg, 10 mg/kg and 30 mg/kg, 10 mg/kg and 20 mg/kg, 20 mg/kg and 50 mg/kg, 20 mg/kg and 40 mg/kg, 20 mg/kg and 30 mg/kg, 30 mg/kg and 50 mg/kg, 30 mg/kg and 40 mg/kg, and 40 mg/kg body weight and 50 mg/kg body weight. The dose can be administered a single time, or a multiple times. Appropriate dose amount can be determined by one of skill in the art, based on the regimen of administration. Total dose over a specific period of time can also be selected by one of skill in the art.

The optimal dose range for administration of compositions containing any ADA2 provided herein, including wildtype, variants and modified forms thereof, can be adjusted by plasma monitoring. The dose of administration can be such that the subject will maintain plasma ADA activity in the range of from about 10 to 1,000 mM/hr, and demonstrate a decline in erythrocyte adenosine, i.e., dATP less than or equal to about 0.001 to about 0.057 mM, for example, about 0.005 to about 0.015 mM in packed erythrocytes, or less than or equal to about 1% of the total erythrocyte adenosine (i.e., ATP+dATP content), of the normal adenosine level, as measured in a pre-administration sample. The normal value of dATP is less than about 0.001 mM.

Accordingly, the method provided herein includes a method of treating a tumor comprising administering an effective amount of ADA2 to the subject. An effective amount is readily determined by one of skill in the art to reduce tissue levels of adenosine or deoxyadenosine in the subject, and wherein growth or spread of the tumor is inhibited by substantially reduced tissue levels of adenosine in the subject. Also provided herein are methods to assess the level of adenosine-associated biomarkers in a subject to select a subject for treatment with any ADA2 provided herein. Doses or treatment regimen can be varied or adjusted based on the susceptibility of the patient to the treatment, as determined by one of skill in the art using the methods provided herein.

When ADA2 provided herein is co-formulated or co-administered with another therapeutic agent, such as an immune checkpoint inhibitor agent, a hyaluronan-degrading enzyme or an antitumor agent, dosages can be provided as a ratio of the amount of the ADA2 polypeptide to the amount of the other therapeutic agent administered. For example, an ADA2 polypeptide can be administered at 1 U ADA:1 U other therapeutic agent (1:1) to 50:1 or more, for example, at or about 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1, 50:1 or more. In other examples, an ADA2 polypeptide can be administered at 1 U ADA:1 U other therapeutic agent (1:1) to 1:50 or less, for example, at or about 1:2, 1:3, 1:4, 1:5, 1:6, 1:7, 1:8, 1:9, 1:10, 1:11, 1:12, 1:13, 1:14, 1:15, 1:20, 1:25, 1:30, 1:35, 1:40, 1:45, 1:50 or less.

4. Combination Therapies

In the methods provided herein, ADA2 provided herein, including wildtype, variants and modified forms thereof, can be administered before, after, or concomitantly with one or more other therapeutic regimens or agents. The skilled medical practitioner can determine empirically, or by considering the pharmacokinetics and modes of action of the agents, the appropriate dose or doses of each therapeutic regimen or agent, as well as the appropriate timings and methods of administration. The additional therapeutic regimes or agents can improve the efficacy or safety of the ADA2 provided herein. In some examples, the additional therapeutic regimes or agents can treat the same disease or a comorbidity rather than to alter the action of the ADA2 provided herein. In some examples, the additional therapeutic regimes or agents can ameliorate, reduce or eliminate one or more side effects that are associated with administration of any ADA2 provided herein.

For example, an ADA2 described herein can be administered with chemotherapy, radiation therapy, or both chemotherapy and radiation therapy. Any ADA2 provided herein, including wildtype, variants and modified forms thereof can be administered in combination with one or more other prophylactic or therapeutic agents, including but not limited to antibodies, cytotoxic agents, chemotherapeutic agents, cytokines, growth inhibitory agents, anti-hormonal agents, kinase inhibitors, anti-angiogenic agents, cardioprotectants, immunostimulatory agents, immunosuppressive agents, immune checkpoint inhibitors, antibiotics, angiogenesis inhibitors, or other therapeutic agents. The other therapeutic agent used in combination with the treatment using ADA2 provided herein, can be, for example, a protein, a peptide, a nucleic acid, a small molecule agent, a toxin, a lipid, a carbohydrate or combinations thereof, or any other type of therapeutic agent. In other examples, the additional therapeutic regime can be radiation therapy.

The one or more additional agents can be administered simultaneously, sequentially or intermittently with any of the ADA2 provided herein thereof. The agents can be co-administered with the ADA2 thereof, for example, as part of the same pharmaceutical composition or same method of delivery. In some examples, the agents can be co-administered with the ADA2 provided herein at the same time as the ADA2 thereof, but by a different means of delivery. The agents also can be administered at a different time than administration of the ADA2 thereof, but close enough in time to the administration of the ADA2 to have a combined prophylactic or therapeutic effect. In some examples, the one or more additional agents are administered subsequent to or prior to the administration of the ADA2 provided herein, separated by a selected time period. In some examples, the time period is 1 day, 2 days, 3 days, 4 days, 5 days, 6 days, 1 week, 2 weeks, 3 weeks, 1 month, 2 months, or 3 months. In some examples, the one or more additional agents are administered multiple times and/or the ADA2 provided herein is administered multiple times. In other examples, the ADA2 variants provided herein and the one or more additional agents that are proteins, can be encoded in one or more expression vectors for in vivo expression, particularly, tumor targeted or oncolytic vectors for expression in tumor cells. In yet another example, the ADA2 variant provided herein and the one or more additional agents that are proteins, can be expressed in modified immune cells, and the modified immune cells can be administered for adoptive immunotherapy which can target and deliver ADA2 and additional agent(s) to tumor cells in particular.

a. Anticancer Agents

The method of treatment using ADA2 provided herein can be administered in combination with one or more anticancer agents known in the art. The combination treatment of the present invention includes administering ADA2 with an effective amount of the anticancer agents described herein or known in the art, simultaneously or sequentially. The anticancer agent can be, for example, a chemotherapeutic, an antibody, a peptide, or a gene therapy vector, virus or DNA or combinations thereof.

Exemplary of anticancer agents for the combination treatment include, for example, Taxol™, bevacizumab (Avastin®), vincristine, vinblastine, neomycin, combretastatin(s), podophyllotoxin(s), TNF-α, angiostatin, endostatin, vasculostatin, αv-β3 antagonists, calcium ionophores, calcium-flux inducing agents, and any derivative or prodrug thereof. The anticancer agents for combination therapy also include chemotherapeutic agents, radiotherapeutic agents, cytokines, anti-angiogenic agents, apoptosis-inducing agents or anticancer immunotoxins or coaguligands, for example, Erbitux® (cetuximab). Exemplary chemotherapeutic agents include but are not limited to, 5-azacytidine, 5-fluorouracil, optionally in combination with leucovorin, 5-fluorodeoxyuridine, 6-mercaptopurine, 6-thioguanine, mitoxantrone, aziridinylbenzoquinone (AZQ), Carmustine (BCNU or BCNU; Bristol-Myers Squibb), bleomycin, carboplatin (CBDCA), Lomustine (CCNU), methyl-CCNU or MeC-CNU, chlorambucil, chlorodeoxyadenosine, cisplatin, cyclophosphamide, cytarabine, dactinomycin, daunorubicin, deoxycoformycin, doxorubicin, doxycoformycin, DTIC (dacarbazine), epirubicin, etoposide (VP-16), fludarabine, hexamethylmelamine, hydroxyurea, idarubicin, ifosfamide, ifosfamide and mesna, levamisol, N-acetylcysteine (NAC), 1-phenylalanine mustard, 4'-(9-acridinylamino)methanesulfon-m-anisidide (mAMSA), inhibitors of multiple drug resistance (i.e., MDR inhibitors), melphalan, methotrexate, optionally in combination with leucovorin, mithramycin, mitomycin-c, inhibitors of multidrug resistance related protein ("MRP" inhibitors), paclitaxel, procarbazine, streptozotocin, N,N'N'-triethylenethiophosphoramide ("thioTEPA"), inhibitors of topoisomerase I and/or topoisomerase II, taxol, vinblastine, vincristein, vincristine, vindesine, and teniposide (VM-26®).

Other exemplary anti-cancer agents that can be administered after, coincident with or before administration of any ADA2 provided herein, including wildtype, variants and modified forms thereof, include, but are not limited to Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Ciplactin; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonas; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Flurocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprolides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; Melphalan L-PAMs; Menogarils; Mepitiostanes; Mercaptopurines; 6-Mecaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patupilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycin Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovaricins; Streptozocins; Sufosfamides; Sulofenurs; Sunitinib Malate; 6-TG; Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin A's (Guamecyclines); Zeniplatins; Zilascorbs [2-H]; Zinostatins; Zoledronate; Zorubicins; and Zosuquidars; Aldesleukins (e.g., PROLEUKIN®); Alemtuzumabs (e.g., CAMPATH®); Alitretinoins (e.g., PANRETIN®); Allopurinols (e.g., ZYLOPRIM®); Altretamines (e.g., HEXALEN®); Amifostines (e.g., ETHYOL®); Anastrozoles (e.g., ARIMIDEX®); Arsenic Trioxides (e.g., TRISENOX®); Asparaginases (e.g., ELSPAR®); BCG Live (e.g., TICE® BCG); Bexarotenes (e.g., TARGRETIN®); Bevacizumab (AVASTIN®); Bleomycins (e.g., BLENOXANE®); Busulfan intravenous (e.g., BUSULFEX®); Busulfan orals (e.g., MYLERAN™); Calusterones (e.g., METHOSARB®); Capecitabines (e.g., XELODA®); Carboplatins (e.g., PARAPLATIN®); Carmustines (e.g., BCNU®, BiCNU®); Carmustines with Polifeprosans (e.g., GLIADEL® Wafer); Celecoxibs (e.g., CELEBREX®); Chlorambucils (e.g., LEUKERAN®); Cisplatins (e.g., PLATINOL®); Cladribines (e.g., LEUSTATIN®, 2-CdA®); Cyclophosphamides (e.g., CYTOXAN®, NEOSAR®); Cytarabines (e.g., CYTOSAR-U®); Cytarabine liposomals (e.g., DepoCyt®); Dacarbazines (e.g., DTIC-Domeu): Dactinomycins (e.g., COSMEGEN®); Darbepoetin Alfas (e.g., ARANESP®); Daunorubicin liposomals (e.g. DAUNOXOME®); Daunorubicins/Daunomycins (e.g., CERUBIDINE®); Denileukin Diftitoxes (e.g., ONTAK®); Dexrazoxanes (e.g., ZINECARD®); Docetaxels (e.g., TAXOTERE®); Doxorubicins (e.g., ADRIAMYCIN®, RUBEX®); Doxorubicin liposomals, including Doxorubicin HCL liposome injections (e.g., DOXIL®); Dromostanolone propionates (e.g., DROMOSTANOLONE® and MASTERONE® Injection); Elliott's B Solutions (e.g., Elliott's B Solution®); Epirubicins (e.g., ELLENCE®); Epoetin alfas (e.g., EPOGEN®); Estramustines (e.g., EMCYT®); Etoposide phosphates (e.g., ETOPOPHOS®); Etoposide VP-16s (e.g., VEPESID®); Exemestanes (e.g., AROMASIN®); Filgrastims (e.g., NEUPOGEN®); Floxuridines (e.g., FUDR®); Fludarabines (e.g., FLUDARA®); Fluorouracils incl. 5-FUs (e.g., ADRUCIL®); Fulvestrants (e.g., FASLODEX®); Gemcitabines (e.g., GEMZAR®); Gemtuzumabs/Ozogamicins (e.g., MYLOTARG®); Goserelin acetates (e.g., ZOLADEX®); Hydroxyureas (e.g., HYDREA®); Ibritumomabs/Tiuxetans (e.g., ZEVALIN®); Idarubicins (e.g., IDAMYCIN®); Ifosfamides (e.g., IFEX®); Imatinib mesylates (e.g., GLEEVEC®); Interferon alfa-2as (e.g., ROFERON-A®); Interferon alfa-2bs (e.g., INTRON A®); Irinotecans (e.g., CAMPTOSAR®); Letrozoles (e.g., FEMARA®); Leucovorins (e.g., WELLCOVORIN®, LEUCOVORIN®); Levamisoles (e.g., ERGAMISOL®); Lomustines/CCNUs (e.g., CeeNU®); Mechlorethamines/Nitrogen mustards (e.g., MUSTARGEN®); Megestrol acetates (e.g., MEGACE®); Melphalans/L-PAMs (e.g., ALKERAN®); Mercaptopurine incl. 6-MPs (e.g., PURINETHOL®); Mesnas (e.g., MESNEX®); Methotrexates; Methoxsalens (e.g., UVADEX®); Mitomycin Cs (e.g., MUTAMYCIN®, MITOZYTREX®); Mitotanes (e.g., LYSODREN®); Mitoxantrones (e.g., NOVANTRONE®); Nandrolone Phenpropionates (e.g., DURABOLIN-50®); Nofetumomabs (e.g., VERLUMA®); Oprelvekins (e.g., NEUMEGA®); Oxaliplatins (e.g., ELOXATIN®); Paclitaxels (e.g., PAXENE®, TAXOL®); Pamidronates (e.g., AREDIA®); Pegademases (e.g., ADA- GEN®); Pegaspargases (e.g., ONCASPAR®); Pegfilgrastims (e.g., NEULASTA®); Pentostatins (e.g., NIPENT®); Pipobromans (e.g., VERCYTE®); Plicamycin/Mithramycins (e.g., MITHRACIN®); Porfimer sodiums (e.g., PHOTOFRIN®); Procarbazines (e.g., MATULANE®); Quinacrines (e.g., ATABRINE®); Rasburicases (e.g., ELITEK®); Rituximabs (e.g., RITUXAN®); Sargramostims (e.g., PROKINE®); Streptozocins (e.g., ZANOSAR®); Sunitinib Malates (e.g., SUTENT®); Talcs (e.g., SCLEROSOL®); Tamoxifens (e.g., NOLVADEX®); Temozolomides (e.g., TEMODAR®); Teniposides/VM-26s (e.g., VUMON®); Testolactones (e.g., TESLAC®); Thioguanines incl. 6-TG; Thiotepas (e.g., THIOPLEX®); Topotecans (e.g., HYCAMTIN®); Toremifenes (e.g., FARESTON®); Tositumomabs (e.g., BEXXAR®); Trastuzumabs (e.g., HERCEPTIN®); Tretinoins/ATRA (e.g., VESANOID®); Uracil Mustards; Valrubicins (e.g., VALSTAR®); Vinblastines (e.g., VELBAN®); Vincristines (e.g., ONCOVIN®); Vinorelbines (e.g., NAVELBINE®); and Zoledronates (e.g., ZOMETA®). Any ADA2 provided herein can be used in combination therapy with other anticancer agents, such as those provided herein and/or those described in Goodman and Gilman's The Pharmacological Basis of Therapeutics, Eds. Hardman and Limbird, Tenth edition (2002).

i. Anticancer Antibodies

Examples of anti-cancer antibodies that can be co-administered with any ADA2 provided herein include, but are not limited to, anti 17-IA cell surface antigen antibodies such as Panorex® (edrecolomab); anti-4-1BB antibodies; anti-4Dc antibodies; anti-A33 antibodies such as A33 and CDP-833; anti-α1 integrin antibodies such as natalizumab; anti-α4β7 integrin antibodies such as LDP-02; anti-αVβ1 integrin antibodies such as F-200, M-200, and SJ-749; anti-αBβ3 integrin antibodies such as abciximab, CNTO-95, Mab-17E6, and Vitaxin®; anti-complement factor 5 (C5) antibodies such as 5G1.1; anti-CA125 antibodies such as OvaRex® (oregovomab); anti-CD3 antibodies such as Nuvion® (visilizumab) and Rexomab; anti-CD4 antibodies such as IDEC-151, MDX-CD4, OKT4A; anti-CD6 antibodies such as Oncolysin B and Oncolysin CD6; anti-CD7 antibodies such as HB2; anti-CD19 antibodies such as B43, MT-103, and Oncolysin B; anti-CD20 antibodies such as 2H7, 2H7.v16, 2H7.v114, 2H7.v115, Bexxar® (tositumomab), Rituxan® (rituximab), and Zevalin® (Ibritumomab tiuxetan); anti-CD22 antibodies such as Lymphocide® (epratuzumab); anti-CD23 antibodies such as IDEC-152; anti-CD25 antibodies such as basiliximab and Zenapax® (daclizumab); anti-CD30 antibodies such as AC10, MDX-060, and SGN-30; anti-CD33 antibodies such as Mylotarg® (gemtuzumab ozogamicin), Oncolysin M, and Smart M1 95; anti-CD38 antibodies; anti-CD40 antibodies such as SGN-40 and toralizumab; anti-CD40L antibodies such as 5c8, Antova®, and IDEC-131; anti-CD44 antibodies such as bivatuzumab; anti-CD46 antibodies; anti-CD52 antibodies such as Campath® (alemtuzumab); anti-CD55 antibodies such as SC-1; anti-CD56 antibodies such as huN901-DM1; anti-CD64 antibodies such as MDX-33; anti-CD66e antibodies such as XR-303; anti-CD74 antibodies such as IMMU-1 10; anti-CD80 antibodies such as galiximab and IDEC-1 14; anti-CD89 antibodies such as MDX-214; anti-CD123 antibodies; anti-CD138 antibodies such as B-B4-DM1; anti-CD146 antibodies such as AA-98; anti-CD148 antibodies; anti-CEA antibodies such as cT84.66, labetuzumab, and Pentacea®; anti-CTLA4 antibodies such as MDX-101; anti-CXCR4 antibodies; anti-EGFR antibodies such as ABX-EGF, Erbitux® (cetuximab), IMC-C225, and Merck Mab 425; anti-EpCAM antibodies such as Crucell's anti-EpCAM, ING-1, and IS-IL-2; anti-ephrin B2/EphB4 antibodies; anti-Her2 antibodies such as Herceptin®), MDX-210; anti-FAP (fibroblast activation protein) antibodies such as sibrotuzumab; anti-ferritin antibodies such as NXT-211; anti-FGF-1 antibodies; anti-FGF-3 antibodies; anti-FGF-8 antibodies; anti-FGFR antibodies, anti-fibrin antibodies; anti-G250 antibodies such as WX-G250 and Rencarex®; anti-GD2 ganglioside antibodies such as EMD-273063 and TriGem; anti-GD3 ganglioside antibodies such as BEC2, KW-2871, and mitumomab; anti-gpIIb/IIIa antibodies such as ReoPro; anti-heparinase antibodies; anti-Her2/ErbB2 antibodies such as Herceptin® (trastuzumab), MDX-210, and pertuzumab; anti-HLA antibodies such as Oncolym®, Smart 1D10; anti-HM1.24 antibodies; anti-ICAM antibodies such as ICM3; anti-IgA receptor antibodies; anti-IGF-1 antibodies such as CP-751871 and EM-164; anti-IGF-1R antibodies such as IMC-A12; anti-IL-6 antibodies such as CNTO-328 and elsilimomab; anti-IL-15 antibodies such as HuMax®-IL15; anti-KDR antibodies; anti-laminin 5 antibodies; anti-Lewis Y antigen antibodies such as Hu3S193 and IGN-311; anti-MCAM antibodies; anti-Muc1 antibodies such as BravaRex and TriAb; anti-NCAM antibodies such as ERIC-1 and ICRT; anti-PEM antigen antibodies such as Theragyn and Therex; anti-PSA antibodies; anti-PSCA antibodies such as IG8; anti-Ptk antibodies; anti-PTN antibodies; anti-RANKL antibodies such as AMG-162; anti-RLIP76 antibodies; anti-SK-1 antigen antibodies such as Monopharm C; anti-STEAP antibodies; anti-TAG72 antibodies such as CC49-SCA and MDX-220; anti-TGF-β antibodies such as CAT-152; anti-TNF-α antibodies such as CDP571, CDP870, D2E7, Humira® (adalimumab), and Remicade® (infliximab); anti-TRAIL-R1 and TRAIL-R2 antibodies; anti-VE-cadherin-2 antibodies; and anti-VLA-4 antibodies such as Antegren®. Furthermore, anti-idiotype antibodies including but not limited to the GD3 epitope antibody BEC2 and the gp72 epitope antibody 105AD7, can be used. In addition, bispecific antibodies including but not limited to the anti-CD3/CD20 antibody Bi20 can be used.

ii. Chemotherapeutic Agents

In some examples, any ADA2 provided herein, including wildtype, variants and modified forms thereof, is administered with one or more chemotherapeutic agents. Examples of chemotherapeutic agents include but are not limited to alkylating agents such as thiotepa and cyclophosphamide (CYTOXAN®); alkyl sulfonates such as busulfan, improsulfan and piposulfan; androgens such as calusterone, dromostanolone propionate, epitiostanol, mepitiostane, testolactone; anti-adrenals such as aminoglutethimide, mitotane, trilostane; anti-androgens such as flutamide, nilutamide, bicalutamide, leuprolide, and goserelin; antibiotics such as aclacinomycins, actinomycin, anthramycin, azaserine, bleomycins, cactinomycin, calicheamicin, carubicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti estrogens including for example tamoxifen, raloxifene, aromatase inhibiting 4(5)-imidazoles, 4-hydroxytamoxifen, trioxifene, keoxifene, LY 117018, onapristone, and toremifene (Fareston); anti-metabolites such as methotrexate and 5-fluorouracil (5-FU); folic acid analogues such as denopterin, methotrexate, pteropterin, trimetrexate; aziridines such as benzodepa, carboquone, meturedepa, and uredepa; ethylenimines and methylmelamines including altretamine, triethylenemelamine, triethylenephosphoramide, triethylenethiophosphoramide and trimethylol melamine; folic acid replenisher such as folinic acid; nitrogen mustards such as chlorambucil, chlornaphazine, chlorophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, ranimustine; platinum analogs such as cisplatin and carboplatin; vinblastine; platinum; proteins such as arginine deiminase and asparaginase; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; taxanes, e.g. paclitaxel (TAXOL®, Bristol-Myers Squibb Oncology, Princeton, N.J.) and docetaxel (TAXOTERE®), Rhone-Poulenc Rorer, Antony, France); topoisomerase inhibitor RFS 2000; thymidylate synthase inhibitor (such as Tomudex); additional chemotherapeutics including aceglatone; aldophosphamide glycoside; aminolevulinic acid; amsacrine; bestrabucil; bisantrene; edatrexate; defosfamide; demecolcine; diaziquone; difluoromethylornithine (DMFO); eflornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK®; razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; chlorambucil; gemcitabine; 6-thioguanine; mercaptopurine; methotrexate; etoposide (VP-16); ifosfamide; mitomycin C; mitoxantrone; vincristine; vinorelbine; Navelbine; Novantrone; teniposide; daunomycin; aminopterin; Xeloda; ibandronate; CPT-11; retinoic acid; esperamycins; capecitabine; and topoisomerase inhibitors such as irinotecan. Pharmaceutically acceptable salts, acids or derivatives of any of the above can also be used.

A chemotherapeutic agent can be administered as a prodrug. Examples of prodrugs that can be administered with any ADA2 provided herein include, but are not limited to, phosphate-containing prodrugs, thiophosphate-containing prodrugs, sulfate-containing prodrugs, peptide-containing prodrugs, D-amino acid-modified prodrugs, glycosylated prodrugs, beta-lactam-containing prodrugs, optionally substituted phenoxy acetamide-containing prodrugs or optionally substituted phenylacetamide-containing prodrugs, 5-fluorocytosine and other 5-fluorouridine prodrugs which can be converted into the more active cytotoxic free drug.

iii. Radiation Therapy

Any ADA2 provided herein, including wildtype, variants and modified forms thereof, can be combined with other therapeutic regimens. For example, in one embodiment, the patient to be treated with any ADA2 provided herein can receive radiation therapy. Radiation therapy can be administered according to protocols commonly employed in the art and known to the skilled artisan. Such therapy includes but is not limited to cesium, iridium, iodine, cobalt radiation, irradiation with X-rays, gamma rays, including both direct irradiation and with tomographic targeting, treatment of cancerous tissues with implanted radioactive pellets or "seeds," neutron beam irradiation of tissues primed with boron compounds, and/or other types of particle beam therapy known in the art. The radiation therapy can be whole body irradiation, or can be directed locally to a specific site or tissue in or on the body, such as the lung, bladder, or prostate. Typically, radiation therapy is administered in pulses over a period of time from about 1 to 2 weeks. The radiation therapy can, however, be administered over longer periods of time. For instance, radiation therapy can be administered to patients having head and neck cancer for about 6 to about 7 weeks. Optionally, the radiation therapy can be administered as a single dose or as multiple, sequential doses. The skilled medical practitioner can determine empirically the appropriate dose or doses of radiation therapy useful herein. In some examples, any ADA2 provided herein, including wildtype, variants and modified forms thereof and optionally one or more other anti-cancer therapies are employed to treat cancer cells ex vivo. It is contemplated that such ex vivo treatment can be useful in bone marrow transplantation and particularly, autologous bone marrow transplantation. For instance, treatment of cells or tissue(s) containing cancer cells with any ADA2 provided herein and one or more anti-cancer therapies can be employed to deplete or substantially deplete the cancer cells prior to transplantation in a recipient patient. Radiation therapy can also comprise treatment with an isotopically labeled molecule, such as an antibody. Examples of radioimmunotherapeutics include but Zevalin® (Y-90 labeled anti-CD20), LymphoCide® (Y-90 labeled anti-CD22) and Bexxar® (1-131 labeled anti-CD20). In addition, it is contemplated that any ADA2 provided herein, including wildtype, variants and modified forms thereof, can be administered to a patient or subject in combination with still other therapeutic techniques such as surgery or phototherapy.

iv. Anti-Angiogenic Agents

In some examples, any ADA2 provided herein, including wildtype, variants and modified forms thereof, is administered with one or more anti-angiogenic agents. For example, the anti-angiogenic factor can be a small molecule or a protein (e.g., an antibody, Fc fusion, or cytokine) that binds to a growth factor or growth factor receptor involved in promoting angiogenesis. Examples of anti-angiogenic agents include but are not limited to antibodies that bind to Vascular Endothelial Growth Factor (VEGF) or that bind to VEGF-R, RNA-based therapeutics that reduce levels of VEGF or VEGF-R expression, VEGF-toxin fusions, Regeneron's VEGF-trap, angiostatin (plasminogen fragment), antithrombin III, angiozyme, ABT-627, Bay 12-9566, BeneFin, bevacizumab, bisphosphonates, BMS-275291, cartilage-derived inhibitor (CDI), CAI, CD59 complement fragment, CEP-7055, Col 3, Combretastatin A-4, endostatin (collagen XVIII fragment), farnesyl transferase inhibitors, fibronectin fragment, gro-beta, halofuginone, heparinases, heparin hexasaccharide fragment, HMV833, human chorionic gonadotropin (hCG), IM-862, interferon alpha, interferon beta, interferon gamma, interferon inducible protein 10 (IP-10), interleukin-12, kringle 5 (plasminogen fragment), marimastat, metalloproteinase inhibitors (e.g. TIMPs), 2-methoxyestradiol, MMI 270 (CGS 27023A), plasminogen activator inhibitor (PAI), platelet factor-4 (PF4), prinomastat, prolactin 16 kDa fragment, proliferin-related protein (PRP), PTK 787/ZK 222594, retinoids, solimastat, squalamine, SS3304, SU5416, SU6668, SU11248, tetrahydrocortisol-S, tetrathiomolybdate, thalidomide, thrombospondin-1 (TSP-1), TNP470, transforming growth factor beta (TGF-β), vasculostatin, vasostatin (calreticulin fragment), ZS6126, and ZD6474.

v. Immune Checkpoint Inhibitors

In some examples, any ADA2 provided herein, including wildtype, variants and modified forms thereof, is administered with one or more agents that increases the immune response by blocking an immune checkpoint protein (i.e., immune checkpoint inhibitor). In the combination therapies provided herein, the immune checkpoint inhibitor can be an antibody directed against an immune checkpoint protein, such as an antibody directed against cytotoxic T-lymphocyte antigen 4 (CTLA4 or CD152), programmed cell death protein 1 (PD-1), or programmed cell death protein 1 ligand 1 (PD-L1).

In particular, the combination therapy provided herein is applicable to treating all types of tumors, including cancers, that are associated with elevated adenosine levels and/or susceptible to a reduction in adenosine or deoxyadenosine levels in the subject to be treated. Broadly, these include tumors of the blood as well as solid tumors. Exemplary cancers include, but are not limited to, those that originate in the immune system, skeletal system, muscles and heart, breast, gastrointestinal tract, central and peripheral nervous system, renal system, reproductive system, respiratory system, skin, connective tissue systems, including joints, fatty tissues, and circulatory system, including blood vessel walls.

Therapies for treating cancers include immunotherapies (e.g., inhibitory checkpoint protein antagonists or agonists) that inhibit immunosuppressive signaling or enhance immunostimulant signaling Instead of directly targeting the tumor itself, such therapies use the host's endogenous defenses to combat the tumor. For example, inhibitory checkpoint protein antagonists and/or agonists of co-stimulatory receptors can stimulate a host's endogenous anti-tumor immune response by amplifying antigen-specific T cell responses. Enhancing the host's immune response offers the advantage over cytotoxic therapies in that the effects can be long lasting, such that the subject can develop a durable anti-tumor response that can persist for months to years after cessation of treatment.

In particular examples, the combination therapies provided herein employ an agent (e.g., antibody) that targets an inhibitory checkpoint protein. Exemplary inhibitory immune checkpoint target proteins and therapeutic antibodies for the targets are provided in Table 5.

TABLE 5

Exemplary inhibitory immune checkpoint target proteins and inhibitors

| Target | Target Function | Antibody/fusion protein | Synonyms and Code Names |
|---|---|---|---|
| CTLA4 | Inhibitory receptor | Ipilimumab | (MDX-CTLA4; BMS-734016; MDX-010) |
|  |  | Tremelimumab | (ticilimumab; CP-675,206) |
| PD-1 | Inhibitory receptor | MK-3475 | (Pembrolizumab; Lambrolizumab; SCH 900475) |
|  |  | AMP-224 | (anti-PD-1 fusion protein AMP-224) |
|  |  | Nivolumab | (BMS-936558; MDX-1106; ONO-4538) |
|  |  | Pidilizumab | (CT-011) |
| PD-L1 | Ligand for PD-1 | MDX-1105 | (RG7446) |
|  |  | BMS-936559 |  |
|  |  | MED14736 |  |
|  |  | MPDL33280A |  |
| LAG3 | Inhibitory receptor | IMP321 | ImmuFact |
| B7-H3 | Inhibitory ligand | MGA271 |  |
| B7-H4 | Inhibitory ligand |  |  |
| TIM3 | Inhibitory receptor |  |  |
| CD25 | inhibitory receptor subunit |  |  |
| CD137 | stimulatory receptor |  |  |
| OX40 | stimulatory receptor |  |  |
| 4-1BB | co-stimulatory receptor | Aptamer ligand |  |
| IDO | immunosuppressive enzyme |  |  |

In particular, inhibitors of the immunologic inhibitory molecules CTLA4, PD-1 and PD-L1 are contemplated for the combinations and methods provided herein. While both CTLA4 and PD-1 function as negative regulators, each places a non-redundant role in modulating immune responses: CTLA4 is involved in attenuating the early activation of naïve and memory (resting) T cells, whereas PD-1 plays a role in modulating T cell activity in peripheral tissues (see, e.g., Keir et al. (2008) *Annu Rev Immunol.* 26:677-704; Pardoll, (2012) *Nat Rev Cancer.* 12(4):252-264; Quezada et al., (2013) *Br J Cancer.* 108(8): 1560-1565; Callahan et al., (2010) *Semin Oncol.* 37(5):473-84).

Cytotoxic T-lymphocyte-associated antigen 4 (CTLA4; also called CD152; SEQ ID NO:544) is a co-inhibitory receptor that is packaged in vesicles that are maintained in the cytoplasm of naïve or resting T cells. When T cell activation is initiated, transportation of the vesicles containing CTLA4 to the surface of the T cell is also triggered. The inhibitory activity of CTLA4 acts to dampen the amplitude of the stimulatory signals. In this role, CTLA4 functions to reduce T-cell activity and thereby limit autoimmunity. CTLA4 also plays a role in down-modulation of helper T cell activity and in enhancing regulatory T ($T_{reg}$) cell activity Inhibition of CTLA4, for example by administering anti-CTLA4 antibodies, can enhance the immune response by increasing the activity of CTLs, increasing the presence of effector and helper T cells and/or by inhibiting the suppressive functions of $T_{reg}$ cells. Inhibition of CTLA4 allows full activation of the T cells during the priming phase of the immune response.

Upon T cell activation and entry into the bloodstream, expression of programmed cell death protein 1 (PD-1; SEQ ID NO:545), a receptor that inhibits T cell activation, is induced. PD-1 also is present on regulatory T ($T_{reg}$) cells, exhausted T cells, activated B cells, natural killer (NK) cells, dendritic cells (DCs) and activated monocytes. PD-1 has two principal ligands, PD-1 ligand 1 (PD-L1; also called B7-H1 or CD274; SEQ ID NO:546) and PD-L2 (also called B7-DC or CD273). Inflammatory signals in tissues induce the expression of PD-L1 and PD-L2. Upon binding one of its ligands, PD-1 acts to attenuate T cell activity, by inhibiting signaling of the T cell receptor (TCR), downregulation the secretion of immunostimulatory cytokines and expression of survival proteins, and increasing T cell production of the immunosuppressive cytokine IL-10. These activities serve to limit collateral tissue damage and limit autoimmunity during an immune response under normal conditions. Blocking the PD-1 signaling pathway, for example by administering anti-PD-1 or anti-PD-L1 antibodies, results in restoration of T cell effector functions, such as tumor-specific T cell effector functions, such as killing tumor cells and secretion of immunostimulatory cytokines, such as interferon gamma (IFN-γ), interleukin-2 (IL-2) and tumor necrosis factor alpha (TNF-α).

Other immune checkpoint ligands and receptors are involved in modulating the immune response and can be targets for therapies aimed at enhancing antitumor immunity. Further, blockade of two or more of coordinately expressed receptors or ligands can produce additive or synergistic antitumor activities. Targets include B7 inhibitory ligands, other than PD-L1 an PD-L2, such B7-H3 and B7-H4, which are upregulated on tumor cells or tumor infiltrating cells. Other targets, which are associated with inhibition of lymphocyte activity, include lymphocyte activation gene 3 (LAG3; also called CD223), 2B4 (also called CD244), B and T lymphocyte attenuator (BTLA; or CD272), T cell membrane protein 3 (TIM3; or HAVcr2), Adenosine A2a receptor (A2aR), and the family of killer inhibitory receptors. Many of these immune checkpoint receptors regulate the activity of effector T cells and $T_{reg}$ cells. For example, LAG3 is highly expressed on $T_{reg}$ cells (which help prevent autoimmunity), where it is thought to be important for amplifying immunosuppressive activity. LAG3 also is associated with inhibition of effector T-cell activity and can induce T-cell anergy (Pardoll, (2012) Nat Rev Cancer. 12(4):252-264. Antibody targeting of these proteins alone or in combination can enhance antitumor immunity in animal cancer models. Because many tumor cells express multiple inhibitory ligands, and tumor infiltrating lymphocytes express multiple inhibitory receptors, a combinatorial approach to inhibiting these proteins can be effective in enhancing antitumor immunity (see Pardoll, (2012) Nat Rev Cancer. 12(4):252-264 for a review). In addition to secreted or membrane-bound inhibitory ligands, metabolic enzymes such as indoleamine 2,3 dioxygenase (IDO) and arginase, which are expressed by inhibitory myeloid-derived suppressor cells that commonly infiltrate tumors, can locally inhibit immune responses by depleting amino acids essential for anabolic metabolism of T cells. These enzymes can be inhibited by small molecule drugs.

Since immune checkpoint inhibitors act on immune cells to enhance immune responses, the increased response when provided in combination with any ADA2 provided herein, including wildtype, variants and modified forms thereof, can be due to effects on increasing access of immune cells (e.g., CTLs) to the tumor. For example, as described above, tumor and stromal cells produce a high level of adenosine, which can exert immunosuppressive effects. By reducing the adenosine-mediated immunosuppression, there can be an increased activity of circulating immune cells against the tumors, thereby increasing the number of cytotoxic and other immune cells available to kill tumor cells. The efficacy of anti-tumor agents or drugs, such as immune checkpoint inhibitors (e.g., anti-CTLA4 antibody), can also be increased.

Hence, the use of any ADA2 provided herein, including wildtype, variants and modified forms thereof, for example, PEGylated ADA2), can sensitize a tumor to immune-mediated responses, which can be further increased in the presence of an immune checkpoint inhibitor (e.g., anti-CTLA4 antibody, and anti-PD1 antibody or an anti-PD-L1 antibody). Enhancing the activity of immune cells against the tumor, i.e. reducing the effect of adenosine-mediated immunosuppression, by any ADA2 provided herein, can allow for reduced dosage of the immune checkpoint inhibitor, while maintaining or enhancing therapeutic efficacy. The ability to more effectively fine tune the antibody dosage can result in a reduction in adverse events that can be associated with the antibody therapy. Thus, the combination therapy provided herein can facilitate an enhanced anti-tumor immune response for the eradication of tumors and tumor treatment.

The combination therapy, including compositions, combinations and methods and use thereof, provided herein contains inhibitors of immune checkpoint proteins that block an immune checkpoint protein to stimulate an anti-tumor immune response. Such immune checkpoint inhibitors are known in the art. Examples of such inhibitors are provided herein, and include any inhibitory agent that targets an inhibitory checkpoint protein described in Table 5. For example, the immune checkpoint inhibitor or inhibitory agent is an inhibitor of CTLA4, PD-1 and PD-L1. In particular examples, the immune checkpoint inhibitor is an antibody or an aptamer. Exemplary inhibitors of CTLA4, PD-1 and PD-L1 include anti-CTLA4, anti-PD-1 and anti-PD-L1 antibodies and aptamers.

An inhibitor that is an aptamer can be employed in the combination therapy provided herein. An aptamer includes oligonucleotide (DNA, RNA, or XNA) or peptide aptamers. An aptamer can be monovalent or multivalent, such as bivalent or tetravalent. In some cases, the aptamer can be modified by polymers, such as cholesterol or polyethylene glycol (PEG) to extend the half-life of circulating aptamers.

In particular examples, the immune checkpoint inhibitor is an antibody that blocks an immune checkpoint molecule (e.g. anti-CTLA4, anti-PD-1 and anti-PD-L1). The antibody can be a full-length antibody or an antigen-binding fragment thereof that immunospecifically binds to the immune checkpoint molecule (e.g., CTLA4, PD-1 and PD-L1). Other immunomodulatory agents which are contemplated for use in the combinations, methods, and uses provided herein include inhibitory agents targeted against the inhibitory receptors lymphocyte-activation gene 3 (LAG3) and T cell membrane protein 3 (TIM3), inhibitory ligands such as PD-L2 (or B7-H2), B7-H3, B7-H4, and CD25, and the immunosuppressive enzyme Indoleamine 2,3-dioxygenase (IDO). Agents directed against LAG3 (e.g., fusion protein IMP321 and multiple mAbs) and anti B7-H3 antibodies (e.g., MGA271) have been characterized and are in use in clinical trials. Antibodies or inhibitory agents of B7-H4 and TIM3 are in preclinical development (Pardoll, Nat Rev Cancer. 2012 Mar. 22; 12(4):252-264). Any one of more of these agents can be included in any of the combinations provided herein. In addition, variants and modified forms of the antibodies can also be used in the method of combination therapy provided herein.

(a) Anti-CTLA4 Therapies

Two antibodies that block CTLA4, Ipilimumab and Tremelimumab, have been used for the effective treatment of some cancers, such as melanoma, pancreatic cancer, ovarian cancer, prostate cancer, renal cell cancer (RCC), colorectal cancer (CRC), gastric cancer, and NSCLC (see Kyi et al., (2014) *FEBS Letters* 588:368-376 for a review). Therapeutic CTLA4 blockade can effect tumor regression months to years after completion of therapy (Prieto et al., (2012) *Clin Cancer Res.* 18(7):2039-2047; Kirckwood et al., (2010) *Clin Cancer Res.* 16(3):1042-1048), but also can reduce tolerance to other host tissues, leading to adverse events, such as immune-related adverse events (irAEs).

The combination therapies provided herein, including compositions and methods and uses thereof, can include therapeutic agents that inhibit CTLA4 Inhibitors include antibodies and aptamers. Antibody and aptamer inhibitors that bind to CTLA4 and inhibit CTLA4 signaling are known. Exemplary aptamers which bind CTLA4, inhibit CTLA4 function, and enhance tumor immunity have been described and are set forth in SEQ ID NOS:384-388, 539-541 (Santulli-Marotto (2003) *Cancer Res.* 63(21):7483-7489; Gilboa et al., (2013) *Clin Cancer Res* 19(5): 1054-1062).

Several antibodies, which bind and inhibit CTLA4 activity, have been described which have been used in anti-tumor immunotherapy. Anti-CTLA4 antibodies include, but are not limited to, any of those described in U.S. Pat. Nos. 6,682,736, 6,984,720; U.S. Publ. Nos. 2002/0086014; 2009/0074787; EP 1262193; and WO 2000/037504. In particular, anti-CTLA4 antibodies include Ipilimumab (also called MDX-010, MDX-101, 10D1; Drug Bank Accession No. DB06186) and Tremelimumab (also called Ticilimumab, CP-675,206 or 11.2.1).

For example, an anti-CTLA4 antibody for use in the combination therapy provided herein can include Ipilimumab (also called MDX-010, MDX-101, 10D1; Drug Bank Accession No. DB06186) or derivatives thereof, such as variants or antigen-binding fragments of Ipilimumab. Ipilimumab is a fully human IgG1κ monoclonal antibody that specifically binds human CTLA4 (see, e.g., antibody designated 10D1 in US Patent Publication No. 2002/0086014 and U.S. Pat. No. 6,984,720). The heavy chain of Ipilimumab has a variable domain ($V_H$) with the sequence of amino acids set forth in SEQ ID NO:390, encoded by the sequence of nucleotides set forth in SEQ ID NO:389. The complementarity determining regions (CDRs) of the heavy chain include $V_H$ CDR 1 (set forth in SEQ ID NO:393); $V_H$ CDR 2 (set forth in SEQ ID NO:394); and $V_H$ CDR 3 (set forth in SEQ ID NO:395). The light chain of Ipilimumab has a variable domain ($V_L$) with the sequence of amino acids set forth in SEQ ID NO:392, encoded by the sequence of nucleotides set forth in SEQ ID NO:391. The CDRs of the light chain include, $V_L$ CDR 1 (set forth in SEQ ID NO:396); $V_L$ CDR 2 (set forth in SEQ ID NO:397); and $V_L$ CDR 3 (set forth in SEQ ID NO:398). When recombinantly produced, Ipilimumab is made up of four polypeptide chains; two identical heavy chains of 447 amino acids each and two identical kappa light chains of 215 amino acids each. Each heavy and light chain pair is linked through an interchain disulfide bond.

In another example, an anti-CTLA4 antibody for use in the combination therapy provided herein can include Tremelimumab (also called Ticilimumab, CP-675,206 or 11.2.1) or derivatives thereof, such as variants or antigen-binding fragments of Tremelimumab. Tremelimumab is a fully human IgG2 monoclonal antibody that specifically binds human CTLA4 (see e.g., antibody designated 11.2.1 of WO 00/37504). The heavy chain of Tremelimumab has a variable domain ($V_H$) with the sequence of amino acids set forth in SEQ ID NO:400, encoded by the sequence of nucleotides set forth in SEQ ID NO:399. The complementarity determining regions (CDRs) of the heavy chain include $V_H$ CDR 1 (set forth in SEQ ID NO:471); $V_H$ CDR 2 (set forth in SEQ ID NO:472); and $V_H$ CDR 3 (set forth in SEQ ID NO:473). The light chain of Tremelimumab has a variable domain ($V_L$) with the sequence of amino acids set forth in SEQ ID NO:402, encoded by the sequence of nucleotides set forth in SEQ ID NO:401. The CDRs of the light chain include, $V_L$ CDR 1 (set forth in SEQ ID NO:474); $V_L$ CDR 2 (set forth in SEQ ID NO:475); and $V_L$ CDR 3 (set forth in SEQ ID NO:476). When recombinantly produced, Tremelimumab is made up of four polypeptide chains; two identical heavy chains and two identical kappa light chains. Each heavy and light chain pair is linked through an interchain disulfide bond.

These anti-CTLA4 antibodies have been involved in numerous clinical trials for the treatment of cancers. Ipilimumab is FDA approved for the treatment of melanoma and has been in clinical trials for other cancers, such as prostate cancer, lung cancer, and RCC. Tremelimumab has been investigated in clinical trials for the treatment of CRC, gastric cancer, melanoma and NSCLC.

The anti-CTLA4 antibodies in the combination therapy provided herein also can include variants of Ipilimumab or Tremelimumab, or antigen-binding fragments thereof that include the variations, where the variant antibody immunospecifically binds CTLA4. The variations can be, for example, amino acid replacements, insertion or deletion of amino acids.

(b) Anti-PD-1 and Anti-PD-L1 Therapies

The combination therapies provided herein, including compositions and methods and uses thereof, include therapeutic agents that inhibit PD-1 or PD-L1 Inhibitors that include antibodies and fusion proteins, aptamers, Antibody, aptamer and fusion protein inhibitors that bind to PD-1 or PD-L1 and inhibit PD-1 inhibitory signaling are known. Exemplary fusion proteins include AMP-224 (also known as B7-DCIg), which is a PD-L2-Fc fusion soluble receptor described in WO2010/027827 and WO2011/066342.

Several antibodies, which bind PD-1 or PD-L1 and inhibit PD-1-inhibitory activity, have been described which have been used in anti-tumor immunotherapy. Anti-PD-1 antibodies include, but are not limited to, any of those described in U.S. Pat. Nos. 7,943,743, 8,008,449, 8,779,105, 8,735,553; U.S. Publication Nos. 2005/0180969 2007/0166281; and International Patent Pub. No. WO 2008/156712. Anti-PD-L1 antibodies include, but are not limited to, any of those described in U.S. Publ. Nos. 2013/0034559 and 2013/0045202; U.S. Pat. Nos. 7,943,743, 8,217,149, 8,679,767, and 8,779,108; and Intl. Publ. Nos. WO 2010/077634 and WO 2013/019906.

In particular, anti-PD-1 antibodies include Nivolumab (also known as BMS-936558, MDX-1106, ONO-4538 or 5C4), MK-3475 (also known as Pembrolizumab, Lambrolizumab or h409A11), Pidilizumab (also known as hBAT-1 or CT-011), and AMP-224 (also known as B7-DCIg). These anti-PD-1 antibodies have been involved in numerous clinical trials for the treatment of cancers, such as melanoma, NSCLC, RCC, hematologic malignancies, lymphomas, leukemias, pancreatic cancer, prostate cancer, lung cancer, and multiple myeloma.

For example, an anti-PD-1 antibody for use in the combination therapy provided herein can include Nivolumab (also known as BMS-936558, MDX-1106, ONO-4538 or 5C4) or derivatives thereof, such as variants or antigen-binding fragments of Nivolumab. Nivolumab is a fully human IgG4 monoclonal antibody that specifically binds human PD-1 (see, e.g., antibody designated 5C4 in U.S. Pat.

No. 8,008,449). The heavy chain of Nivolumab has a variable domain (VH) with the sequence of amino acids set forth in SEQ ID NO:404, encoded by the sequence of nucleotides set forth in SEQ ID NO:403. The complementarity determining regions (CDRs) of the heavy chain include VH CDR 1 (set forth in SEQ ID NO:407); VH CDR 2 (set forth in SEQ ID NO:408); and VH CDR 3 (set forth in SEQ ID NO:409). The light chain of Nivolumab has a variable domain (VL) with the sequence of amino acids set forth in SEQ ID NO:406, encoded by the sequence of nucleotides set forth in SEQ ID NO:405. The CDRs of the light chain include, VL CDR 1 (set forth in SEQ ID NO:410); VL CDR 2 (set forth in SEQ ID NO:411); and VL CDR 3 (set forth in SEQ ID NO:412). When recombinantly produced, Nivolumab is made up of four polypeptide chains; two identical heavy chains and two identical kappa light chains. Each heavy and light chain pair is linked through an interchain disulfide bond.

In another example, an anti-PD-1 antibody for use in the combination therapy provided herein can include MK-3475 (also called Pembrolizumab, Lambrolizumab or h409A11) or derivatives thereof, such as variants or antigen-binding fragments of MK-3475. MK-3475 is a humanized IgG4K monoclonal antibody that specifically binds human PD-1 (see, e.g., antibody designated h409A11 in WO 2008/156712). The complete heavy chain of MK-3475 has the sequence of amino acids set forth in SEQ ID NO:414, encoded by a sequence of nucleotides set forth in SEQ ID NO:413, and the complete light chain has the sequence of amino acids set forth in SEQ ID NO:416, encoded by a sequence of nucleotides set forth in SEQ ID NO:415. The heavy chain is composed of a variable domain (VH), with an amino acid sequence set forth in SEQ ID NO:418, encoded by a sequence of nucleotides set forth in SEQ ID NO:417). The light chain is composed of a variable domain (VL) with an amino acid sequence set forth in SEQ ID NO:420, encoded by a sequence of nucleic acids set forth in SEQ ID NO:419) and a humanized kappa light constant region. When recombinantly produced, MK-3475 is made up of four polypeptide chains; two identical heavy chains of 447 amino acids each and two identical kappa light chains of 218 amino acids each. Each heavy and light chain pair is linked through an interchain disulfide bond.

The CDRs of MK-3475 include, VH CDR 1 (SEQ ID NO:421); VH CDR 2 (SEQ ID NO:422); VH CDR 3 (SEQ ID NO:423); VL CDR 1 (SEQ ID NO:424); VL CDR 2 (SEQ ID NO:425); and VL CDR 3 (SEQ ID NO:426).

In another example, an anti-PD-1 antibody for use in the combination therapy provided herein can include Pidilizumab (also called hBAT-1 or CT-011) or derivatives thereof, such as variants or antigen-binding fragments of Pidilizumab. Pidilizumab is a humanized IgG1 monoclonal antibody that was generated from a murine antibody (BAT), which was raised against B lymphoid cell membranes, and has been shown to elicit T-cell- and NK-cell-based activities. Pidilizumab binds human PD-1 (see, e.g., antibody designated BAT-1 RκD/RHC in US 2005/0180969). The complete heavy chain of Pidilizumab has the sequence of amino acids set forth in SEQ ID NO:428, encoded by a sequence of nucleotides set forth in SEQ ID NO:427, and the complete light chain has the sequence of amino acids set forth in SEQ ID NO:430, encoded by a sequence of nucleotides set forth in SEQ ID NO:429. The heavy chain is composed of a variable domain (VH), with an amino acid sequence set forth in SEQ ID NO:432, encoded by a sequence of nucleotides set forth in SEQ ID NO:431. The light chain is composed of a variable domain (VL,) with an amino acid sequence set forth in SEQ ID NO:434, encoded by a sequence of nucleic acids set forth in SEQ ID NO:433, and a humanized kappa light constant region. When recombinantly produced, Pidilizumab is made up of four polypeptide chains; two identical heavy chains and two identical kappa light chains Each heavy and light chain pair is linked through an interchain disulfide bond.

The CDRs of Pidilizumab include, VH CDR 1 (amino acid sequence set forth in SEQ ID NO:435); VH CDR 2 (amino acid sequence set forth in SEQ ID NO:436); VH CDR 3 (amino acid sequence set forth in SEQ ID NO:437); VL CDR 1 (amino acid sequence set forth in SEQ ID NO:438); VL CDR 2 (amino acid sequence set forth in SEQ ID NO:439); and VL CDR 3 (amino acid sequence set forth in SEQ ID NO:440).

The anti-PD-1 antibodies in the combination therapy provided herein also can include variants of Nivolumab, MK-3475, Pidilizumab, and AMP-224, or antigen-binding fragments thereof that include the variations, where the variant antibody immunospecifically binds PD-1. The variations can be, for example, amino acid replacements, insertion or deletion of amino acids.

In particular, anti-PD-L1 (or anti-B7H1) antibodies include, but are not limited to, the antibodies called BMS-936559 (also known as MDX-1105 or 12A4), MPDL3280A (also known as RG7446), and MEDI4736. These anti-PD-L1 antibodies have been involved in numerous clinical trials for the treatment of cancers, such as melanoma, NSCLC, ovarian cancer, RCC, and lung cancer.

For example, an anti-PD-L1 antibody for use in the combination therapy provided herein can include BMS-936559 (also known as MDX-1105 or 12A4) or derivatives thereof, such as variants or antigen-binding fragments of BMS-936559. BMS-936559 is a fully human IgG4 monoclonal antibody that specifically binds human PD-L1 (see, e.g., antibody designated 12A4 in U.S. Pat. No. 7,943,743). The heavy chain of BMS-936559 has a variable domain (VH) with the sequence of amino acids set forth in SEQ ID NO:442, encoded by the sequence of nucleotides set forth in SEQ ID NO:441. The complementarity determining regions (CDRs) of the heavy chain include VH CDR 1 (set forth in SEQ ID NO:445); VH CDR 2 (set forth in SEQ ID NO:446); and VH CDR 3 (set forth in SEQ ID NO:447). The light chain of BMS-936559 has a variable domain (VL) with the sequence of amino acids set forth in SEQ ID NO:444, encoded by the sequence of nucleotides set forth in SEQ ID NO:443. The CDRs of the light chain include, VL CDR 1 (set forth in SEQ ID NO:448); VL CDR 2 (set forth in SEQ ID NO:449); and VL CDR 3 (set forth in SEQ ID NO:450). When recombinantly produced, BMS-936559 is made up of four polypeptide chains; two identical heavy chains and two identical kappa light chains. Each heavy and light chain pair is linked through an interchain disulfide bond.

In another example, an anti-PD-L1 antibody for use in the combination therapy provided herein can include MPDL3280A (also known as RG7446) or derivatives thereof, such as variants or antigen-binding fragments of MPDL3280A. MPDL3280A is a fully human IgG4 monoclonal antibody that specifically binds human PD-L1 (see, e.g., U.S. Pat. No. 8,217,149 and WO 2013/019906). MPDL3280A contains a heavy chain variable domain (VH) with the sequence of amino acids set forth in SEQ ID NO:463 and a light chain variable domain (VL) with the sequence of amino acids set forth in SEQ ID NO:464. The full-length antibody contains a heavy chain sequence of amino acids set forth in SEQ ID NO:477 or 479 and a light chain sequence of amino acids set forth in SEQ ID NO:478.

The full-length antibody also is reported to contain a heavy chain sequence of amino acids set forth in SEQ ID NO:461 and light chain sequence set forth in SEQ ID NO:462 (see WO 2013019906). The complementarity determining regions (CDRs) of the heavy chain include VH CDR 1 (set forth in SEQ ID NO:465); VH CDR 2 (set forth in SEQ ID NO:466); and VH CDR 3 (set forth in SEQ ID NO:467). The CDRs of the light chain include, VL CDR 1 (set forth in SEQ ID NO:468); VL CDR 2 (set forth in SEQ ID NO:469); and VL CDR 3 (set forth in SEQ ID NO:470). When recombinantly produced, MPDL3280A is made up of four polypeptide chains; two identical heavy chains and two identical kappa light chains. Each heavy and light chain pair is linked through an interchain disulfide bond.

In another example, an anti-PD-L1 antibody for use in the combination therapy provided herein can include MEDI4736 or derivatives thereof, such as variants or antigen-binding fragments of MEDI4736. MEDI4736 is a fully human IgG1κ monoclonal antibody that specifically binds human PD-L1 (see, e.g., antibody designated 2.7A4OPT in U.S. Publ. No. 2013/0034559). The heavy chain of MEDI4736 has a variable domain (VH) with the sequence of amino acids set forth in SEQ ID NO:452, encoded by the sequence of nucleotides set forth in SEQ ID NO:451. The complementarity determining regions (CDRs) of the heavy chain include VH CDR 1 (set forth in SEQ ID NO:455); VH CDR 2 (set forth in SEQ ID NO:456); and VH CDR 3 (set forth in SEQ ID NO:457). The light chain of MEDI4736 has a variable domain (VL) with the sequence of amino acids set forth in SEQ ID NO:454, encoded by the sequence of nucleotides set forth in SEQ ID NO:453. The CDRs of the light chain include, VL CDR 1 (set forth in SEQ ID NO:458); VL CDR 2 (set forth in SEQ ID NO:459); and VL CDR 3 (set forth in SEQ ID NO:460). When recombinantly produced, MEDI4736 is made up of four polypeptide chains; two identical heavy chains and two identical kappa light chains Each heavy and light chain pair is linked through an interchain disulfide bond.

The anti-PD-L1 antibodies in the combination therapy provided herein also can include variants of BMS-936559, MPDL3280A, and MEDI4736, or antigen-binding fragments thereof that include the variations, where the variant antibody immunospecifically binds PD-L1. The variations can be, for example, amino acid replacements, insertion or deletion of amino acids.

b. Other Immunomodulatory Agents

In some examples, any ADA2 provided herein, including wildtype, variants and modified forms thereof, is administered with one or more immunomodulatory agents. Such agents can increase or decrease production of one or more cytokines, up- or down-regulate self-antigen presentation, mask MHC antigens, or promote the proliferation, differentiation, migration, or activation state of one or more types of immune cells. Examples of immunomodulatory agents include but are not limited to non-steroidal anti-inflammatory drugs (NSAIDs) such as aspirin, ibuprofen, celecoxib, diclofenac, etodolac, fenoprofen, indomethacin, ketorolac, oxaprozin, nabumetone, sulindac, tolmetin, rofecoxib, naproxen, ketoprofen, and nabumetone; steroids (e.g. glucocorticoids, dexamethasone, cortisone, hydrocortisone, methylprednisolone, prednisone, prednisolone, triamcinolone, azulfidine eicosanoids such as prostaglandins, thromboxanes, and leukotrienes; as well as topical steroids such as anthralin, calcipotriene, clobetasol, and tazarotene); cytokines such as TGFb, IFNa, IFNb, IFNg, IL-2, IL4, IL-10; cytokine, chemokine, or receptor antagonists including antibodies, soluble receptors, and receptor-Fc fusions against BAFF, B7, CCR2, CCR5, CD2, CD3, CD4, CD6, CD7, CD8, CD11, CD14, CD15, CD17, CD18, CD20, CD23, CD28, CD40, CD40L, CD44, CD45, CD52, CD64, CD80, CD86, CD147, CD152, complement factors (C5, D) CTLA4, eotaxin, Fas, ICAM, ICOS, IFNα, IFNβ, IFNγ, IFNAR, IgE, IL-1, IL-2, IL-2R, IL-4, IL-5R, IL-6, IL-8, IL-9 IL-12, IL-13, IL-13R1, IL-15, IL-18R, IL-23, integrins, LFA-1, LFA-3, MHC, selectins, TGFβ, TNFα, TNFβ, TNF-R1, T-cell receptor, including Enbrel® (etanercept), Humira® (adalimumab), and Remicade® (infliximab); heterologous anti-lymphocyte globulin; other immunomodulatory molecules such as 2-amino-6-aryl-5 substituted pyrimidines, anti-idiotypic antibodies for MHC binding peptides and MHC fragments, azathioprine, brequinar, Bromocryptine, cyclophosphamide, cyclosporine A, D-penicillamine, deoxyspergualin, FK506, glutaraldehyde, gold, hydroxychloroquine, leflunomide, malononitriloamides (e.g. leflunomide), methotrexate, minocycline, mizoribine, mycophenolate mofetil, rapamycin, and sulfasalazine.

In some examples, any ADA2 provided herein, including wildtype, variants and modified forms thereof, is administered with one or more cytokines. Examples of cytokines include but are not limited to lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-alpha and -beta; mullerian-inhibiting substance; mouse gonadotropin-associated peptide; inhibin; activin; vascular endothelial growth factor; integrin; thrombopoietin (TPO); nerve growth factors such as NGF-beta; platelet-growth factor; transforming growth factors (TGFs) such as TGF-alpha and TGF-beta; insulin-like growth factor-I and -II; erythropoietin (EPO); osteoinductive factors; interferons such as interferon-alpha, beta, and -gamma; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1alpha, IL-2, IL-3, IL-4, IL-5, IL-6, IL-7, IL-8, IL-9, IL-10, IL-11, IL-12; IL-15, a tumor necrosis factor such as TNF-alpha or TNF-beta; and other polypeptide factors including LIF and kit ligand (KL).

In addition to inhibitory antibodies that target and inhibit immune checkpoint proteins, agonistic antibodies, which are capable of stimulating an immune response by binding its target protein/receptor, are contemplated for use in the combinations, methods, and uses provided herein. For example, Urelumab (also known as BMS-663513 and anti-4-1BB) is an agonist humanized monoclonal antibody targeting the CD137 co-receptor, that is a member of the tumor necrosis factor (TNF)/nerve growth factor (NGF) family of receptors and is expressed on dendritic cells, follicular dendritic cells, natural killer cells, granulocytes and cells of blood vessel walls at sites of inflammation, with immunostimulatory properties. Urelumab specifically binds to and activates CD137-expressing immune cells, stimulating an immune response, in particular a cytotoxic T cell response, which can be mounted against tumor cells when administered as a part of a combination therapy provided herein (see, e.g., Vinay et al., (2012) *Mol Cancer Ther.* 11(5):1062-1070). Other 4-1BB agonists also can be included in the combinations provided herein, such as any described by Snell et al. in Immunol Rev. 244:197-217

(2011). OX40 (also known as CD134) is another immunostimulatory receptor, of the TNF family, which can be targeted by incorporating OX40 agonists, such as those described by Weinberg et al. in *Immunol Rev.* 244(1):218-231 (2011), into the combinations provided herein. Aptamer ligands which bind and stimulate 4-1BB or OX40 signaling also have been described (Gilboa et al., *Clin Cancer Res.* 19(5):1054-1062) and are contemplated for inclusion in the combination therapies provided herein.

In some examples, any ADA2 provided herein, including wildtype, variants and modified forms thereof, is administered with one or more cytokines or other agents that stimulate cells of the immune system and enhance desired effector function. For example, agents that stimulate NK cells, including but not limited to IL-2 can be administered with an any ADA2 provided herein. In another embodiment, agents that stimulate macrophages, including but not limited to C5a, formyl peptides such as N-formyl-methionyl-leucyl-phenylalanine (Beigier-Bompadre et. al. (2003) *Scand. J. Immunol.* 57: 221-8), can be administered with any ADA2 provided herein. Also, agents that stimulate neutrophils, including but not limited to G-CSF and GM-CSF, can be administered with any ADA2 provided herein. Furthermore, agents that promote migration of such immunostimulatory cytokines can be administered with any ADA2 provided herein. Also additional agents including but not limited to interferon gamma, IL-3 and IL-7 can promote one or more effector functions. In some examples, any ADA2 provided herein is administered with one or more cytokines or other agents that inhibit effector cell function.

c. Hyaluronan-Degrading Enzyme

The combination therapy, including combinations and methods and use thereof, provided herein can contain, in addition to the ADA2 provided herein, an anti-hyaluronan agent, such as a soluble hyaluronan-degrading enzyme. Hyaluronan-degrding enzymes are enzymes that catalyze the hydrolysis of hyaluronan, and can temporarily degrade hyaluronan Hyaluronan is a component of the extracellular matrix and a major constituent of the interstitial barrier. Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating β-1→4 and β-1→3 glycosidic bonds. Hyaluronan chains can reach about 25,000 disaccharide repeats or more in length and polymers of hyaluronan can range in size from about 5,000 to 20,000,000 Da in vivo. By catalyzing the hydrolysis of hyaluronan, a major constituent of the interstitial barrier, hyaluronan degrading enzymes lower the viscosity of hyaluronan, thereby increasing tissue permeability. As such, hyaluronan degrading enzymes, such as hyaluronidases, have been used, for example, as spreading or dispersing agents in conjunction with other agents, drugs and proteins to enhance their dispersion and delivery.

Certain diseases also are associated with expression and/or production of hyaluronan, including inflammatory diseases and cancers. HA is linked to a variety of biological processes involved with progression of such diseases (see e.g. Itano et al. (2008) *Semin Cancer Biol* 18(4):268-274; Tammi et al. (2008) *Semin Cancer Biol* 18(4):288-295). For example, HA is linked to biological processes associated with tumor progression, including epithelial-mesenchymal transition, and the p53 tumor suppressor pathway. Also, HA is involved in increased water uptake and interstitial fluid pressure (IFP) in disease tissues, such as tumors, thereby resulting in compressed tumor vasculature. For example, at sites of inflammation or in a tumor focus, there is rapid accumulation of hyaluronan, other matrix components and water. Because of this rapid accumulation, the diseased site cannot come to equilibrium with its environment and therefore has a higher interstitial fluid pressure than normal tissues.

Treatment with hyaluronan degrading enzymes, such as polymer-conjugated soluble hyaluronidase (e.g. PEGPH20) can degrade HA on accumulated tissues and cells, including on tumor cells. This treatment can reduce the hyaluronan such that the tissue deflates, the blood vessels expand, and more blood can flow through the site. Accordingly, treatment with a hyaluronan-degrading enzyme, such as a soluble hyaluronidase or polymer-conjugated soluble hyaluronidase (e.g. PEGPH20), can diminish interstitial fluid pressure (IFP) and water content at the tissue site and associated increased vascular perfusion, thereby treating hyaluronan-associated diseases and conditions, such as tumors and cancers. Accordingly, hyaluronan degrading enzymes for the combinations, uses and methods provided include any enzyme having the ability to catalyze the cleavage of a hyaluronan disaccharide chain or polymer.

Hyaluronan-degrading enzymes include hyaluronidases, as well as other enzymes such as chondrotinases and lyases that have the ability to cleave hyaluronan. Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Five hyaluronidase-like genes have been identified in the human genome, PH20 (or SPAM1), HYAL1, HYAL2, HYAL3, HYAL4 and HYALP1.

Mammalian hyaluronidases can be further subdivided into those that are neutral active, predominantly found in testes extracts, and acid active, predominantly found in organs such as the liver. HYALP1 is a pseudogene, and HYAL3 has not been shown to possess enzyme activity toward any known substrates. HYAL4 is a chondroitinase and exhibits little activity towards hyaluronan HYAL1 is the prototypical acid-active enzyme and PH20 (precursor polypeptide set forth in SEQ ID NO:551 and mature protein set forth in SEQ ID NO:480) is the prototypical neutral-active enzyme. Acid-active hyaluronidases, such as HYAL1 and HYAL2 generally lack catalytic activity at neutral pH (i.e., pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosyl-phosphatidyl inositol (GPI) anchor such as human HYAL2 and human PH20 (Danilkovitch-Miagkova et al. (2003) *Proc Natl Acad Sci USA* 100(8):4580-4585), and those which are generally soluble such as human HYAL1 (Frost et al. (1997) *Biochem Biophys Res Commun.* 236(1):10-15). Many hyaluronidases also are glycosylated, and require glycosylation for activity. For example, human PH20 contains six N-linked glycosylation sites at N82, N166, N235, N254, N368, N393 and S490 of the polypeptide exemplified in SEQ ID NO:551.

PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. The human PH20 mRNA transcript is normally translated to generate a 509 amino acid precursor polypeptide (SEQ ID NO:551) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 therefore, is a 474 amino acid polypeptide set forth in SEQ ID NO:480. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:551. In contrast, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-636). This unique feature of bovine hyaluronidase has permitted the use of the soluble bovine testes hyaluronidase enzyme as an extract for clinical use (Wydase®, Hyalase®).

Hence, hyaluronan-degrading enzymes exist in membrane-bound or soluble forms that are secreted from cells. Hyaluronan-degrading enzymes can be made soluble to be expressed and secreted from cells. For example, where hyaluronan-degrading enzymes include a glycosylphosphatidylinositol (GPI) anchor and/or are otherwise membrane-anchored or insoluble, hyaluronan-degrading enzymes can be provided in soluble form by truncation or deletion of all or a portion of the GPI anchor to render the enzyme secreted and soluble. Soluble hyaluronan-degrading enzymes can be used in the method of combination therapy provided herein. Thus, hyaluronan-degrading enzymes include truncated variants, e.g. truncated to remove all or a portion of a GPI anchor. Examples of such soluble hyaluronidases include soluble PH20 hyaluronides, such as any set forth in U.S. Pat. No. 7,767,429; U.S. Publication Nos. US20040268425, US20100143457 or US20130302275, see also exemplary soluble human PH20 hyaluronidases set forth in any of SEQ ID NOS:481-488, 493-514, or 526-532).

Various forms of hyaluronan degrading enzymes, including hyaluronidases have been prepared and approved for therapeutic use in subjects, including humans. For example, animal-derived hyaluronidase preparations include Vitrase® (ISTA Pharmaceuticals), a purified ovine testicular hyaluronidase, Amphadase® (Amphastar Pharmaceuticals), a bovine testicular hyaluronidase and Hydase™ (Prima Pharm Inc.), a bovine testicular hyaluronidase. Hylenex® (Halozyme Therapeutics) is a human recombinant hyaluronidase produced by genetically engineered Chinese Hamster Ovary (CHO) cells containing nucleic acid encoding soluble forms of PH20, designated rHuPH20 (see e.g., U.S. Publication Nos. US20040268425; U.S. Pat. No. 7,767,429). It is understood that any hyaluronidase preparation can be used in the method of combination therapy provided herein (see, e.g., U.S. Pat. Nos. 2,488,564, 2,488,565, 2,676,139, 2,795,529, 2,806,815, 2,808,362, 5,747,027 and 5,827,721 and International PCT Publication No. WO2005/118799; U.S. Publication Nos. US20040268425; U.S. Pat. No. 7,767,429; or any provided herein).

Described herein is a non-limiting examples of hyaluronan-degrading enzymes, such as hyaluronidase enzymes or soluble hyaluronidase enzyme, for example PH20, for use in the combinations and methods provided herein. Generally, such hyaluronan-degrading enzymes include those that are conjugated to a polymer. The hyaluronan-degrading enzyme, such as a hyaluronidase, can be, for example, of human origin, mammalian origin, bacterial origin, or other biological origin. In other examples, the hyaluronan-degrading enzyme can be modified, for example, by conjugation to a polymer.

Soluble Hyaluronan Degrading Enzymes (e.g. Soluble PH20)

In particular, provided herein is a method of combination therapy and compositions that include any ADA2 protein provided herein, such as any variant ADA2 protein, and a soluble hyaluronan degrading enzymes, such as a soluble hyaluronidase (e.g. soluble PH20). Soluble hyaluronan degrading enzymes include any hyaluronan degrading enzymes that are secreted from cells (e.g. CHO cell) upon expression and exist in soluble form. Such enzymes include, but are not limited to, soluble hyaluronidases, including non-human soluble hyaluronidases, including non-human animal soluble hyaluronidases, bacterial soluble hyaluronidases and human hyaluronidases, Hyal1, bovine PH20 and ovine PH20, allelic variants thereof and other variants thereof. For example, included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme is a soluble neutral active hyaluronidase, such as a soluble PH20 polypeptide The soluble PH20 polypeptide can be an ovine PH20, bovine PH20 or a soluble PH20 that is C-terminally truncated and lacks all or a portion of the GPI anchor attachment sequence. For example, exemplary of a soluble hyaluronidase is PH20 from any species or truncated forms thereof lacking all or a portion of the C-terminal GPI anchor, so long as the hyaluronidase is soluble (secreted upon expression) and retains hyaluronidase activity. In some instances, the soluble hyaluronan degrading enzyme, such as soluble PH20 is normally GPI-anchored (such as, for example, human PH20) and is rendered soluble by truncation at the C-terminus. Such truncation can remove all of the GPI anchor attachment signal sequence, or can remove only some of the GPI anchor attachment signal sequence. For example, up to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or more C-terminal amino acid residues can be removed. The resulting polypeptide, however, is soluble. In instances where the soluble hyaluronan degrading enzyme, such as a soluble PH20, retains a portion of the GPI anchor attachment signal sequence, up to 1, 2, 3, 4, 5, 6, 7, 8, 9 or more amino acid residues in the GPI-anchor attachment signal sequence can be retained, provided the polypeptide is soluble. One of skill in the art can determine whether a polypeptide is GPI-anchored using methods well known in the art. Such methods include, but are not limited to, using known algorithms to predict the presence and location of the GPI-anchor attachment signal sequence and ω-site, and performing solubility analyses before and after digestion with phosphatidylinositol-specific phospholipase C (PI-PLC) or D (PI-PLD).

Typically, the soluble hylauronan degrading enzyme, such as a soluble PH20, is human. Although hyaluronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Exemplary of a soluble hyaluronidase is soluble human PH20. Soluble forms of recombinant human PH20 have been produced and are known. The production of such soluble forms of PH20 is described in U.S. Published Patent Application Nos. US20040268425; US20050260186, US20060104968, US20100143457 and International PCT application No. WO2009111066. Included among these polypeptides are soluble PH20 polypeptides that completely lack all or a portion of the GPI-anchor attachment signal sequence. For example, a soluble PH20 (esPH20) polypeptides can contain at least one amino acid of the GPI anchor or can lack all amino acid residues of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NO:480, or allelic or species variants or other variants thereof.

Soluble forms of human PH20 generally include those that contain amino acids 36-464 set forth in SEQ ID NO:551. For example, soluble forms include, but are not limited to, C-terminal truncated polypeptides of human PH20 set forth in SEQ ID NO:551 having a C-terminal amino acid residue 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:551, mature forms thereof, or polypeptides that exhibit at least 85% identity thereto. For example, when expressed in mammalian cells, the 35 amino acid N-terminal signal sequence is cleaved during processing, and the mature form of the protein is produced and can be secreted. Thus, the mature soluble polypeptides contain amino acids 36 to 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of SEQ ID NO:441. Table 6 provides non-limiting examples of exemplary C-terminally truncated soluble PH20 polypeptides, including precursor and mature forms thereof. In Table 6 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 6 for comparison.

TABLE 6

Exemplary C-terminally truncated PH20 polypeptides

| Precursor | | | Mature | | |
|---|---|---|---|---|---|
| amino acids of SEQ ID NO: 551 | length (aa) | SEQ ID NO | amino acids of SEQ ID NO: 551 | length (aa) | SEQ ID NO |
| 1-509 | 509 | 551 | 36-509 | 474 | 480 |
| 1-500 | 500 | | 36-500 | 465 | 526 |
| 1-499 | 499 | | 36-499 | 464 | 493 |
| 1-498 | 498 | | 36-498 | 463 | 527 |
| 1-497 | 497 | | 36-497 | 462 | 494 |
| 1-496 | 496 | | 36-496 | 461 | 528 |
| 1-495 | 495 | | 36-495 | 460 | 495 |
| 1-494 | 494 | | 36-494 | 459 | 529 |
| 1-493 | 493 | | 36-493 | 458 | 496 |
| 1-492 | 492 | | 36-492 | 457 | 530 |
| 1-491 | 491 | | 36-491 | 456 | 497 |
| 1-490 | 490 | | 36-490 | 455 | 499 |
| 1-489 | 489 | | 36-489 | 454 | 498 |
| 1-488 | 488 | | 36-488 | 453 | 531 |
| 1-487 | 487 | | 36-487 | 452 | 500 |
| 1-486 | 486 | | 36-486 | 451 | 532 |
| 1-485 | 485 | | 36-485 | 450 | 501 |
| 1-484 | 484 | | 36-484 | 449 | 502 |
| 1-483 | 483 | | 36-483 | 448 | 488 |
| 1-482 | 482 | | 36-482 | 447 | 481 |
| 1-481 | 481 | | 36-481 | 446 | 482 |
| 1-480 | 480 | | 36-480 | 445 | 483 |
| 1-479 | 479 | | 36-479 | 444 | 484 |
| 1-478 | 478 | | 36-478 | 443 | 485 |
| 1-477 | 477 | | 36-477 | 442 | 486 |
| 1-476 | 476 | | 36-476 | 441 | 503 |
| 1-475 | 475 | | 36-475 | 440 | 504 |
| 1-474 | 474 | | 36-474 | 439 | 505 |
| 1-473 | 473 | | 36-473 | 438 | 506 |
| 1-472 | 472 | | 36-472 | 437 | 507 |
| 1-471 | 471 | | 36-471 | 436 | 508 |
| 1-470 | 470 | | 36-470 | 435 | 509 |
| 1-469 | 469 | | 36-469 | 434 | 510 |
| 1-468 | 468 | | 36-468 | 433 | 511 |
| 1-467 | 467 | | 36-467 | 432 | 487 |
| 1-466 | 466 | | 36-466 | 431 | 512 |
| 1-465 | 465 | | 36-465 | 430 | 513 |
| 1-464 | 464 | | 36-464 | 429 | 514 |

For example, soluble forms of PH20 for use in combinations provided herein include, for example, polypeptide that has the sequence of amino acids set forth in any of SEQ ID NOS:481-488, 493-514, or 526-532, or a sequence of amino acids that exhibits at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS:481-488, 493-514, or 526-532 and are soluble and retain hyaluronidase activity. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:551) of a human PH20 polypeptide, or soluble form thereof, are generally invariant and are not altered. Other residues that confer glycosylation and formation of disulfide bonds required for proper folding also can be invariant.

In particular, a soluble human PH20 polypeptide is a polypeptide that is truncated after amino acid 482 of the sequence set forth in SEQ ID NO:551. Such a polypeptide can be generated from a nucleic acid molecule containing a signal sequence and encoding amino acids 36-482. The signal sequence can be the native signal sequence, an IgG kappa signal sequence or other signal sequence capable of processing the protein for secretion. Post translational processing removes the signal sequence, leaving a 474 amino acid soluble recombinant human PH20 (SEQ ID NO:480). A product produced upon expression results in a secreted product, designated rHuPH20, in the culture medium that exhibits heterogeneity at the C-terminus such that the product includes a mixture of species that can include any one or more of SEQ ID NOS:481-486 in various abundance. Typically, rHuPH20 is produced in cells that facilitate correct N-glycosylation to retain activity, such as mammalian cells, for example CHO cells (e.g., DG44 CHO cells). Hylenex® (Halozyme) is a human recombinant hyaluronidase produced by genetically engineered Chinese Hamster Ovary (CHO) cells containing nucleic acid encoding a truncated human PH20 polypeptide (designated rHuPH20).

Variants of PH20, such as a human PH20 (e.g., a soluble human PH20) are known and are described in U.S. published appl. No. US2013/0302275. Any PH20 variant described in U.S. published appl. No. US2013/0302275 can be incorporated into a soluble PH20 polypeptide for use in the combination provided herein. Such variants include those that exhibit increased resistance to a denaturation condition (e.g., a phenolic preservative) or increased activity. An example of such a polypeptide is a soluble human PH20 containing the amino acid replacement F204P, V58K or V58R with reference to the sequence of amino acids set forth in full length human PH20 set forth in SEQ ID NO:480 or in a soluble human PH20 set forth in any of SEQ ID NOS:481-488, 493-514, or 526-532.

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g., DG44 CHO cells).

Hyaluronan degrading enzymes, including hyaluronidases (e.g., PH20), in the combinations provided herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

The hyaluronan degrading enzymes can be administered in forms that increase half-life. For example, the hyaluronan degrading enzyme can be provided as part of a liposome or multicellular laminar vesicle or other such delivery vehicle (see, e.g., Example 24 herein). The hyaluronan degrading enzyme can be encoded in a vector, such as an oncolytic vector or targeted vector for delivery.

The hyaluronan-degrading enzyme, such as a soluble hyaluronidase (e.g. a soluble PH20 polypeptide) provided in the combinations herein can be modified by a polymer. In some examples, the polymer is a polyalkylene glycol, dextran, pullulan or cellulose. Polyalkylene glycol polymers, which can modify the hyaluronan-degrading enzyme include polyethylene glycol (PEG) and methoxypolyethylene glycol (mPEG). In examples where the hyaluroanan-degrading enzyme is modified by PEG, the PEG can by branched or linear. In some embodiments, the polymer can be produced by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-propionaldehyde (PEG-propionaldehyde) (30 kDa). In some embodiments, the polymer can be a PEG that has a molecular weight of 30 or about 30 kilodaltons.

d. Antibodies to Treat Infectious Diseases

In some examples, any ADA2 provided herein, such as a wildtype, variants and modified forms thereof, is administered with one or more antibodies or antibody fragments to treat infectious diseases. Examples of antibodies that can be co-administered to treat infectious diseases include, but are not limited to, anti-anthrax antibodies such as ABthrax, anti-CMV antibodies such as CytoGam and sevirumab, anti-cryptosporidium antibodies such as CryptoGAM, Sporidin-G, anti-helicobacter antibodies such as Pyloran, anti-hepatitis B antibodies such as HepeX-B, Nabi-HB, anti-HIV antibodies such as HRG-214, anti-RSV antibodies such as felvizumab, HNK-20, palivizumab, RespiGam, and anti-*staphylococcus* antibodies such as Aurexis, Aurograb, BSYX-A110, and SE-Mab.

e. Antibiotics and Antifungals

In some examples, any ADA2 provided herein, including wildtype, variants and modified forms thereof, is administered with one or more antibiotics, including but not limited to: aminoglycoside antibiotics (e.g. apramycin, arbekacin, bambermycins, butirosin, dibekacin, gentamicin, kanamycin, neomycin, netilmicin, paromomycin, ribostamycin, sisomicin, spectinomycin), aminocyclitols (e.g. spectinomycin), amphenicol antibiotics (e.g. azidamfenicol, chloramphenicol, florfenicol, and thiamphenicol), ansamycin antibiotics (e.g. rifamide and rifampin), carbapenems (e.g. imipenem, meropenem, panipenem); cephalosporins (e.g. cefaclor, cefadroxil, cefamandole, cefatrizine, cefazedone, cefozopran, cefpimizole, cefpiramide, cefpirome, cefprozil, cefuroxime, cefixime, cephalexin, cephradine), cephamycins (cefbuperazone, cefoxitin, cefininox, cefmetazole, and cefotetan); lincosamides (e.g. clindamycin, lincomycin); macrolide (e.g. azithromycin, brefeldin A, clarithromycin, erythromycin, roxithromycin, tobramycin), monobactams (e.g. aztreonam, carumonam, and tigemonam); mupirocin; Oxacephems (e.g. flomoxef, latamoxef, and moxalactam); penicillins (e.g. amdinocillin, amdinocillin pivoxil, amoxicillin, bacampicillin, benzylpenicillinic acid, benzylpenicillin sodium, epicillin, fenbenicillin, floxacillin, penamecillin, penethamate hydriodide, penicillin o-benethamine, penicillin O, penicillin V, penicillin V benzoate, penicillin V hydrabamine, penimepicycline, and phenethicillin potassium); polypeptides (e.g. bacitracin, colistin, polymixin B, teicoplanin, vancomycin); quinolones (amifloxacin, cinoxacin, ciprofloxacin, enoxacin, enrofloxacin, fleroxacin, flumequine, gatifloxacin, gemifloxacin, grepafloxacin, lomefloxacin, moxifloxacin, nalidixic acid, norfloxacin, ofloxacin, oxolinic acid, pefloxacin, pipemidic acid, rosoxacin, rufloxacin, sparfloxacin, temafloxacin, tosufloxacin, and trovafloxacin); rifampin; streptogramins (e.g. quinupristin, dalfopristin); sulfonamides (sulfanilamide, sulfamethoxazole); tetracyclines (chlortetracycline, demeclocycline hydrochloride, demethylchlortetracycline, doxycycline, Duramycin, minocycline, neomycin, oxytetracycline, streptomycin, tetracycline, and vancomycin).

In some examples, any ADA2 provided herein, including wildtype, variants and modified forms thereof, is administered with one or more anti-fungal agents, including but not limited to amphotericin B, ciclopirox, clotrimazole, econazole, fluconazole, flucytosine, itraconazole, ketoconazole, miconazole, nystatin, terbinafine, terconazole, and tioconazole. In some examples, an ADA2 provided herein is administered with one or more antiviral agents, including but not limited to protease inhibitors, reverse transcriptase inhibitors, and others, including type I interferons, viral fusion inhibitors, neuraminidase inhibitors, acyclovir, adefovir, amantadine, amprenavir, clevudine, enfuvirtide, entecavir, foscarnet, ganciclovir, idoxuridine, indinavir, lopinavir, pleconaril, ribavirin, rimantadine, ritonavir, saquinavir, trifluridine, vidarabine, and zidovudine.

I. EXAMPLES

The following examples are included for illustrative purposes only and are not intended to limit the scope of the invention.

Example 1

Cloning of Human Adenosine Deaminase 2 (ADA2) and Generation of ADA2 Variants

A. Cloning of Wildtype (WT) ADA2

The wild type human adenosine deaminase (ADA2) gene including its signal sequence (nucleic acid sequence set forth in SEQ ID NO:1; encoding the amino acid sequence set forth in SEQ ID NO:2 (precursor)) was amplified and cloned between the ScaI and XhoI restriction sites of the pCMV-Script vector (Agilent Technologies, Santa Clara, Calif.; Cat. No. 212220; sequence set forth in SEQ ID NO:6). At the C-terminal end of the coding sequence, the stop codon was replaced by nucleic acid sequence encoding the FLAG™ tag (nucleic acid sequence set forth in SEQ ID NO:8; encoding the amino acid sequence set forth in SEQ ID NO:9) and a stop codon, for purposes of protein purification and/or detection. The resulting construct pCMV-Script-hADA2-FLAG encodes the WT recombinant human ADA2-FLAG polypeptide (amino acid sequence set forth in SEQ ID NO:7).

B. Generation of ADA2 Variants

This resulting construct encoding the WT rHuADA2 described above was used to introduce site-specific amino acid substitutions to create ADA2 variants. As described in the subsections below, site-specific amino acid substitutions were generated based on modeling studies of ADA2 to identify residues indicated to be involved in heparin binding, catalytic activity, and/or to attenuate protein-protein interactions between ADA2 and any other receptors to which ADA2 binds. Each of the generated ADA2 variant was made from the pCMV-Script-hADA2-FLAG vector described above, with site-specific substitutions using the QuikChange Lightning Multi Site-Directed Mutagenesis Kit (Agilent Technologies, Santa Clara, Calif.; Cat. No. 210514) according to the manufacturer's instructions.

The generated variants are set forth in Table 7-12 below. The variants are designated with Zavialov numbering, adopted from the numbering used in the PDB accession Nos. 3LGG and 3LGD (amino acid sequence of the polypeptide used for crystal structure set forth in SEQ ID NO:4; based on Zavialov et al., J. Biol. Chem. 285:12367-12377 (2010)), and with mature ADA2 numbering, based on the mature human ADA2 amino acid sequence set forth in SEQ ID NO:5 (based on Uniprot accession No. Q9NZK5; the precursor amino acid sequence, containing amino acids residues 1-29 of the signal sequence, is set forth in SEQ ID NO:2). Table 1 sets forth the corresponding position numbers of Zavialov numbering (SEQ ID NO:4) and mature ADA2 numbering (SEQ ID NO:5).

a. Candidate Variants with Altered Heparin Binding

Heparin is a naturally occurring glycosaminoglycan, widely present on the surface of tissue throughout the body. ADA2 is known to physically interact with heparin (Zavialov et al., J. Biol. Chem. 285:12367-12377 (2010)), binding to heparin could deplete circulating levels of administered ADA2. To generate ADA2 variants with improved pharmacokinetics, replacement of residues identified herein, based on modeling studies, as involved in heparin binding were made. Two available crystal structures of human ADA2, as described in Zavialov et al., J. Biol. Chem. 285:12367-12377 (2010), were used to identify candidate positions for mutagenesis: crystal structure of ADA2 lacking bound heparin and expressed from *drosophila* cells (RCSB Protein Data Bank (PDB) No. 3LGG; human ADA2 bound to the transition state analog coformycin); and human ADA2 in the apo form (Protein Data Bank accession No. 3LGD; empty enzyme without any cofactors or substrates bound). From the crystal structures, electrostatic surface potential was calculated to identify surfaces on ADA2 that possess positive electrostatic potential, using the open source 3D molecular visualization package PyMOL. Surfaces with positive electrostatic potential can form complementary electrostatic interactions with the highly negatively charged heparin sulfate. From the electrostatic surface potential calculations, a set of lysine and arginine residues were identified as candidate sites for substitution with the amino acids alanine (for replacement of the positively charged lysine or arginine side chain with a methylene group without impacting the protein phi-psi angles), aspartate or glutamate (the two known negatively charged amino acids), to generate a charge repulsion between heparin and the ADA2 variant.

Based on the modeling, amino acid residues 14, 16, 23, 29, 220, 261, 280, 286, 312, 320, 324, 369, 374, 375, 444, 447, 455, 464, 472 or 473 by Zavialov numbering (corresponding to residues 11, 13, 20, 26, 217, 258, 277, 283, 309, 317, 321, 352, 366, 371, 372, 441, 444, 452, 461, 469 or 470, respectively, by mature numbering) were targeted for mutagenesis. ADA2 variants were generated by amino acid replacement of the amino acid at the position to alanine, aspartate or glutamate. Single amino acid replacements, as well as double and triple amino acid replacements also were made. Table 7 sets forth the amino acid replacements in exemplary candidate variants. Example 7 describes studies assessing the heparin binding and adenosine deaminase activity of select candidate variants set forth in Table 7.

TABLE 7

Candidate ADA2 Variants for Attenuated Heparin Binding Properties (HBP)

| Replacement (Zavialov numbering) | Replacement (mature ADA2 numbering) | SEQ ID NO: |
|---|---|---|
| K14A | K11A | 13 |
| K14D | K11D | 14 |
| K14E | K11E | 15 |
| K16A | K13A | 16 |
| K16D | K13D | 17 |
| K16E | K13E | 18 |
| R23A | R20A | 28 |
| R23D | R20D | 29 |
| R23E | R20E | 30 |
| K29A | K26A | 71 |
| K29D | K26D | 72 |
| K29E | K26E | 73 |
| R220A | R217A | 74 |
| R220D | R217D | 75 |
| R220E | R217E | 76 |
| K261A | K258A | 77 |
| K261D | K258D | 78 |
| K261E | K258E | 79 |
| R280A | R277A | 80 |
| R280D | R277D | 81 |
| R280E | R277E | 82 |
| R286A | R283A | 83 |
| R286D | R283D | 84 |
| R286E | R283E | 85 |
| K312A | K309A | 86 |
| K312D | K309D | 87 |
| K312E | K309E | 88 |
| K320A | K317A | 89 |
| K320D | K317D | 90 |
| K320E | K317E | 91 |
| K324A | K321A | 92 |
| K324D | K321D | 93 |
| K324E | K321E | 94 |
| R355A | R352A | 95 |
| R355D | R352D | 96 |
| R355E | R352E | 97 |
| R369A | R366A | 31 |
| R369D | R366D | 32 |
| R369E | R366E | 33 |
| K374A | K371A | 19 |
| K374D | K371D | 20 |
| K374E | K371E | 21 |
| K375A | K372A | 22 |
| K375D | K372D | 23 |
| K375E | K372E | 24 |
| R444A | R441A | 98 |
| R444D | R441D | 99 |
| R444E | R441E | 100 |
| K447A | K444A | 101 |
| K447D | K444D | 102 |
| K447E | K444E | 103 |
| K455A | K452A | 25 |
| K455D | K452D | 26 |
| K455E | K452E | 27 |
| K464A | K461A | 104 |
| K464D | K461D | 105 |
| K464E | K461E | 106 |
| K472A | K469A | 107 |
| K472D | K469D | 108 |
| K472E | K469E | 109 |
| K473A | K470A | 110 |
| K473D | K470D | 111 |
| K473E | K470E | 112 |

TABLE 7-continued

Candidate ADA2 Variants for Attenuated Heparin Binding Properties (HBP)

| Replacement (Zavialov numbering) | Replacement (mature ADA2 numbering) | SEQ ID NO: |
|---|---|---|
| K14A/R23A | K11A/R20A | 55 |
| K14A/R23A/K374A | K11A/R20A/K371A | 56 |
| R23A/K374A | R20A/K371A | 57 |
| K14A/K374A | K11A/K371A | 58 | b. Candidate Active Site (AS) Variants

To generate ADA2 variants with improved catalytic efficiency, candidate variants were generated by replacement of amino acid residues in the active site as identified based on molecular modeling studies. The crystal structures of human ADA2, bound to the transition state analog coformycin (Protein Data Bank accession No. 3LGG) and in the apo form (Protein Data Bank accession No. 3LGD), as described above, were visualized using the open source 3D molecular modeling program PyMol. In silico site directed mutagenesis was performed using PyMol to evaluate the packing of introduced amino acid side chains to adenosine or adjacent residues within the active site, assess packing to adjacent residues near the active site or on the active pocket cleft, measure distances and potential for steric clashes of introduced residues, asses changes to the relative concavity of the active site pocket, and assess the potential for adenosine to access the active site. The selected residues targeted for mutagenesis were those identified herein as candidates for effecting improved catalytic efficiency ($k_{cat}/K_m$) for adenosine, and thereby have increased adenosine deaminase activity.

Based on the modeling, amino acid residues 89, 182, 222, 224, 265, 267, 269, 270 and 299 by Zavialov numbering (corresponding to residues 86, 179, 219, 221, 262, 264, 266, 267, or 296, by mature numbering) were targeted for mutagenesis. ADA2 variants were generated by amino acid replacement of the amino acid at the position to all nineteen other amino acids. Table 8 sets forth the amino acid replacements of exemplary candidate variants. Example 10 describes studies assessing the adenosine deaminase activity of select candidate variants.

TABLE 8

Candidate rHuADA2 Active Site (AS) variants

| Replacement (Zavialov numbering) | Replacement (mature numbering) | SEQ ID NO: |
|---|---|---|
| D89A | D86A | 113 |
| D89C | D86C | 114 |
| D89E | D86E | 115 |
| D89F | D86F | 116 |
| D89G | D86G | 117 |
| D89H | D86H | 118 |
| D89I | D86I | 119 |
| D89K | D86K | 120 |
| D89L | D86L | 121 |
| D89M | D86M | 122 |
| D89N | D86N | 123 |
| D89P | D86P | 124 |
| D89Q | D86Q | 125 |
| D89R | D86R | 126 |
| D89S | D86S | 127 |
| D89T | D86T | 128 |
| D89V | D86V | 129 |
| D89W | D86W | 130 |
| D89Y | D86Y | 131 |

TABLE 8-continued

Candidate rHuADA2 Active Site (AS) variants

| Replacement (Zavialov numbering) | Replacement (mature numbering) | SEQ ID NO: |
|---|---|---|
| E182A | E179A | 46 |
| E182C | E179C | 132 |
| E182D | E179D | 45 |
| E182F | E179F | 133 |
| E182G | E179G | 50 |
| E182H | E179H | 134 |
| E182I | E179I | 135 |
| E182K | E179K | 136 |
| E182L | E179L | 137 |
| E182M | E179M | 138 |
| E182N | E179N | 139 |
| E182P | E179P | 140 |
| E182Q | E179Q | 141 |
| E182R | E179R | 142 |
| E182S | E179S | 47 |
| E182T | E179T | 48 |
| E182V | E179V | 49 |
| E182W | E179W | 143 |
| E182Y | E179Y | 144 |
| R222A | R219A | 41 |
| R222C | R219C | 145 |
| R222D | R219D | 146 |
| R222E | R219E | 147 |
| R222F | R219F | 148 |
| R222G | R219G | 149 |
| R222H | R219H | 150 |
| R222I | R219I | 151 |
| R222K | R219K | 38 |
| R222L | R219L | 152 |
| R222M | R219M | 153 |
| R222N | R219N | 40 |
| R222P | R219P | 154 |
| R222Q | R219Q | 39 |
| R222S | R219S | 155 |
| R222T | R219T | 156 |
| R222V | R219V | 157 |
| R222W | R219W | 158 |
| R222Y | R219Y | 159 |
| L224A | L221A | 42 |
| L224C | L221C | 160 |
| L224D | L221D | 161 |
| L224E | L221E | 162 |
| L224F | L221F | 163 |
| L224G | L221G | 44 |
| L224H | L221H | 164 |
| L224I | L221I | 165 |
| L224K | L221K | 166 |
| L224M | L221M | 167 |
| L224N | L221N | 168 |
| L224P | L221P | 169 |
| L224Q | L221Q | 170 |
| L224R | L221R | 171 |
| L224S | L221S | 172 |
| L224T | L221T | 173 |
| L224V | L221V | 43 |
| L224W | L221W | 174 |
| L224Y | L221Y | 175 |
| S265A | S262A | 51 |
| S265C | S262C | 176 |
| S265D | S262D | 177 |
| S265E | S262E | 178 |
| S265F | S262F | 179 |
| S265G | S262G | 180 |
| S265H | S262H | 181 |
| S265I | S262I | 182 |
| S265K | S262K | 183 |
| S265L | S262L | 184 |
| S265M | S262M | 53 |
| S265N | S262N | 54 |
| S265P | S262P | 185 |
| S265Q | S262Q | 186 |
| S265R | S262R | 187 |
| S265T | S262T | 188 |
| S265V | S262V | 52 |
| S265W | S262W | 189 |
| S265Y | S262Y | 190 |
| H267A | H264A | 34 |
| H267C | H264C | 191 |
| H267D | H264D | 192 |
| H267E | H264E | 193 |
| H267F | H264F | 194 |
| H267G | H264G | 37 |
| H267I | H264I | 195 |
| H267K | H264K | 196 |
| H267L | H264L | 197 |
| H267M | H264M | 198 |
| H267N | H264N | 36 |
| H267P | H264P | 199 |
| H267Q | H264Q | 35 |
| H267R | H264R | 200 |
| H267S | H264S | 201 |
| H267T | H264T | 202 |
| H267V | H264V | 203 |
| H267W | H264W | 204 |
| H267Y | H264Y | 205 |
| S269A | S266A | 206 |
| S269C | S266C | 207 |
| S269D | S266D | 208 |
| S269E | S266E | 209 |
| S269F | S266F | 210 |
| S269G | S266G | 211 |
| S269H | S266H | 212 |
| S269I | S266I | 213 |
| S269K | S266K | 214 |
| S269L | S266L | 215 |
| S269M | S266M | 216 |
| S269N | S266N | 217 |
| S269P | S266P | 218 |
| S269Q | S266Q | 219 |
| S269R | S266R | 220 |
| S269T | S266T | 221 |
| S269V | S266V | 222 |
| S269W | S266W | 223 |
| S269Y | S266Y | 224 |
| K270A | K267A | 225 |
| K270C | K267C | 226 |
| K270D | K267D | 227 |
| K270E | K267E | 228 |
| K270F | K267F | 229 |
| K270G | K267G | 230 |
| K270H | K267H | 231 |
| K270I | K267I | 232 |
| K270L | K267L | 233 |
| K270M | K267M | 234 |
| K270N | K267N | 235 |
| K270P | K267P | 236 |
| K270Q | K267Q | 237 |
| K270R | K267R | 238 |
| K270S | K267S | 239 |
| K270T | K267T | 240 |
| K270V | K267V | 241 |
| K270W | K267W | 242 |
| K270Y | K267Y | 243 |
| V299A | V296A | 244 |
| V299C | V296C | 245 |
| V299D | V296D | 246 |
| V299E | V296E | 247 |
| V299F | V296F | 248 |
| V299G | V296G | 249 |
| V299H | V296H | 250 |
| V299I | V296I | 251 |
| V299K | V296K | 252 |
| V299L | V296L | 253 |
| V299M | V296M | 254 |
| V299N | V296N | 255 |
| V299P | V296P | 256 |
| V299Q | V296Q | 257 |
| V299R | V296R | 258 |
| V299S | V296S | 259 |
| V299T | V296T | 260 |

TABLE 8-continued

Candidate rHuADA2 Active Site (AS) variants

| Replacement (Zavialov numbering) | Replacement (mature numbering) | SEQ ID NO: |
|---|---|---|
| V299W | V296W | 261 |
| V299Y | V296Y | 262 | c. Candidate Variants with Altered Glycosylation

To generate ADA2 variants that are hyperglycosylated, candidate variants were generated by mutation (e.g. insertion and/or amino acid replacement) of residues to create an N-glycosylation site by incorporation of a new N-glycosylation site motif (Asn-Xaa-Ser/Thr). Table 9 sets forth the mutations of exemplary candidate variants.

TABLE 9

Candidate rHuADA2 hyperglycosylation variants

| Mutation (Zavialov numbering) | Mutation (mature numbering) | SEQ ID NO: |
|---|---|---|
| --→N4/--→A5/--→S6 | --→N1/--→A2/--→S3 | 274 |
| R23N/V25S | R20N/V22S | 275 |
| K374N/D376S | K371N/D373S | 276 |
| K375N/I377S | K372N/I374S | 277 |
| T406N/H408S | T403N/H405S | 278 |
| G407N/P409S | G404N/P406S | 279 | d. Candidate Variants Lacking the Receptor Binding (PRB) Domain

To generate ADA2 variants that lack the receptor binding (PRB) domain, residues V102-Q147 (V99-Q144 by mature numbering) or C108-T150 (C105-T147 by mature numbering) were deleted and replaced with a glycine linker of various lengths (e.g., 3, 5, 7, 10 or 15; see SEQ ID NO:280) or (GGGGS)n linker of various length (e.g., n=1, 2 or 3; see SEQ ID NOS:581 and 582). Table 10 sets forth the mutations of exemplary candidate variants.

TABLE 10

Candidate rHuADA2 PRB domain deletion variants

| Mutation (Zavialov numbering) | Mutation (mature numbering) | SEQ ID NO: |
|---|---|---|
| C108-T150del→(Gly)$_{15}$ | C105-T147del→(Gly)$_{15}$ | 281 |
| C108-T150del→(Gly)$_{10}$ | C105-T147del→(Gly)$_{10}$ | 282 |
| C108-T150del→(Gly)$_{7}$ | C105-T147del→(Gly)$_{7}$ | 283 |
| C108-T150del→(Gly)$_{5}$ | C105-T147del→(Gly)$_{5}$ | 284 |
| C108-T150del→(Gly)$_{3}$ | C105-T147del→(Gly)$_{3}$ | 285 |
| V102-Q147del→(GGGGS)$_{1}$ | V99-Q144del→(GGGGS)$_{1}$ | 583 |
| V102-Q147del→(GGGGS)$_{2}$ | V99-Q144del→(GGGGS)$_{2}$ | 584 |
| V102-Q147del→(GGGGS)$_{3}$ | V99-Q144del→(GGGGS)$_{3}$ | 585 |
| C108-T150del→(GGGGS)$_{1}$ | C105-T147del→(GGGGS)$_{1}$ | 586 |
| C108-T150del→(GGGGS)$_{2}$ | C105-T147del→(GGGGS)$_{2}$ | 587 |
| C108-T150del→(GGGGS)$_{3}$ | C105-T147del→(GGGGS)$_{3}$ | 588 | e. Candidate Variants with Altered Glycosylation in the Receptor Binding (PRB) Domain To disrupt the potential interaction of ADA2 with potential receptors through the receptor binding (PRB), ADA2 candidate variants were generated by introducing mutation (e.g. insertion and/or amino acid replacement) of residues to create an N-glycosylation site by incorporation of a new N-glycosylation site motif (Asn-Xaa-Ser/Thr) in the PRB domain. Table 11 sets forth the mutations of exemplary candidate variants.

TABLE 11

Candidate rHuADA2 PRB domain hyperglycosylation variants

| Mutation (Zavialov numbering) | Mutation (mature numbering) | SEQ ID NO: |
|---|---|---|
| R128N/P129A | R125N/P126A | 552 |
| S130N/K132S | S127N/K129S | 553 |
| P129N/E131T | P126N/E128T | 554 |
| R115N/I117T | R112N/I114T | 555 |
| I137N/L138C/L139T | I134N/L135C/L136T | 556 |
| I137N/L138S/L139T | I134N/L135S/L136T | 557 |
| R145N/Q147S | R142N/Q144S | 558 |
| E140N/Y142T | E137N/Y139T | 559 |
| P114N/G116S | P111N/G113S | 560 | f. Candidate Variants with Altered Interaction Between Receptor Binding (PRB) Domain and the ADA Domain To generate ADA2 variants that have altered interaction between the receptor binding (PRB) domain and the rest of ADA2 (e.g., the adenosine deaminase (ADA) domain), mutation(s) were introduced in individual or multiple amino acids in the PRB domain. Structure based design was used to identify residues on the surface of ADA2 in the context of its three dimensional structure that could disrupt the ability of the PRB domain to interact with other contact residues outside of the PRB domain in ADA2. Table 12 sets forth the mutations of exemplary candidate variants.

TABLE 12

Candidate rHuADA2 PRB domain interaction variants

| Mutation (Zavialov numbering) | Mutation (mature numbering) | SEQ ID NO: |
|---|---|---|
| F122S | F119S | 561 |
| F122K | F119K | 562 |
| Y227R | Y224R | 563 |
| Y227N | Y224N | 564 |
| Y194S | Y191S | 565 |
| Y194D | Y191D | 566 |
| F186K | F183K | 567 |
| Y194D/Y227R | Y191D/Y224R | 568 |
| F112S | F109S | 569 |
| F112A | F109A | 570 |
| R121D | R118D | 571 |
| R121A | R118A | 572 |
| Y142T | Y139T | 573 |
| Y142A | Y139A | 574 |
| W136S | W133S | 575 |
| W136T | W133T | 576 |
| P127A | P124A | 577 |
| P127S | P124S | 578 |

Example 2

Production of Recombinant Human Adenosine Deaminase 2 (rHuADA2) and Variants

A. Transient Expression

For transient expression of wildtype ADA2 and variants generated in Example 1, 300 ml of 1.0×10$^6$ cells/ml CHO-S cells (Invitrogen, Cat. No. 11619-012) were transfected with 375 μg of pCMV-Script-hADA2-FLAG plasmid or variant plasmid using FreeStyle™ MAX Reagent (Life Technologies, Carlsbad, Calif.; Cat. No. 16447-500). Transfected cells were grown for 4 days, and culture supernatant was collected by centrifugation at 100 rpm for 10 min.

The collected supernatant was used to purify the protein, either mature ADA2 set forth in SEQ ID NO:5 or a mature variant (e.g. variants set forth in Tables 7-12), each with a FLAG tag. Batch purification was performed using an anti-FLAG M2 affinity resin (Sigma-Aldrich, St. Louis, Mo., Cat. No. A2220), following the manufacturer's instructions. ADA2 were eluted from the resin using FLAG™ peptide. Purity of the eluted protein was assessed using SDS-PAGE and size-exclusion chromatography (SEC). SEC results confirmed that the purified protein was a dimer. N-terminal sequencing also was performed and confirmed the signal sequence corresponds to amino acid residues 1-29 of SEQ ID NO:2, such that the mature protein as purified begins with amino acid residues IDET as set forth in SEQ ID NO:5.

C. Cloning and Stable Expression

The wild type human ADA2 gene (nucleic acid sequence set forth in SEQ ID NO:1) or variant with a C-terminal FLAG™ tag (nucleic acid sequence set forth in SEQ ID NO:8; encoding the amino acid sequence set forth in SEQ ID NO:9) was subcloned into the multiple cloning site (MCS) of lentiviral expression vector pLV-EF1a-MCS-IRES-GFP-Bsd. The resulting expression vector, pLV-EF1a-hADA2-Flag-IRES-GFP-Bsd (nucleic acid sequence set forth in SEQ ID NO:10) was used to generate a lentivirus capable of stably transfecting CHO-S cells. In the expression vector, expression of the recombinant human ADA2 gene was driven by the EF1a promoter. An IRES sequence was inserted after the transgene followed by the cDNA for green fluorescent protein (GFP) used for identification of transduced cells by microscopy, in combination with the blasticidin resistance gene (Bsd) used for selection of transduced cells. The Woodchuck Hepatitis Virus Posttranscriptional Regulatory Element (WPRE) was inserted after the GFP-Bsd sequence to enhance gene expression.

The constructed lentivirus expression vector pLV-EF1a-hADA2-Flag-IRES-GFP-Bsd was used to produce lentivirus as described in the ViraPower™ (Invitrogen, Carlsbad, Calif.) manufacturer's instruction manual. Briefly, 293FT cells were plated at $6 \times 10^6$ cells onto 10 cm tissue culture plates. After 24 hours, 9 µg of the ViraPower™ Packaging Mix (containing a mixture of the pLP1, pLP2, and pLP/VSVG plasmids at 1 µg/µl in TE Buffer, pH 8.0 as supplied by manufacturer) and 3 µg of the pLV-EF1a-hADA2-Flag-IRES-GFP-Bsd lentiviral expression plasmid were mixed in 1.5 mL Opti-MEM (Life Technologies) medium. 36 µL of Lipofectamine™ 2000 (LF2000; Life Technologies, Carlsbad, Calif.) were diluted into 1.5 mL Opti-MEM (Life Technologies). The DNA and LF2000 were mixed gently, and incubated at room temperature for 20 minutes to allow the DNA and lipid to form complexes. In the meantime, the overnight culture medium was replaced with 5.0 mL Opti-MEM+10% FBS without antibiotics. The DNA-LF2000 complexes were added to the 293FT cells for transfection. The cells were incubated overnight at 37° C. in a humidified 5% $CO_2$ incubator. The medium containing the DNA-LF2000 complexes was replaced with 10 mL complete medium and the cells were incubated overnight at 37° C. in a humidified 5% $CO_2$ incubator. The supernatant was collected at 48 hours post-transfection and the medium was transferred to a sterile storage tube. The virus-containing medium was centrifuged at 3000 rpm for 5 minutes to pellet any 293FT cells that were carried over during collection. The supernatant was carefully transferred to a sterile storage tube.

For transduction, CHO-S cells (Life Technologies, Carlsbad, Calif.; Cat. No. 16447-500) were cultured in CD CHO medium (Life Technologies, Carlsbad, Calif.; Cat. No. 10743-029). Transduction of the CHO-S cell line was performed in six-well plates containing $2 \times 10^7$ lentiviral infectious units (IU) and $2 \times 10^6$ CHO-S cells in 2 mL of CD-CHO medium supplemented with 4 mM Glutamax (Invitrogen, Carlsbad Calif.) and 4 µg/mL hexadimethrine bromide (Polybrene; Biosettia, San Diego, Calif.). Infected cells were incubated with shaking at about 30 rpm at 37° C. in a humidified-air incubator with 5% $CO_2$ for 6 hours. The cells were then harvested and centrifuged at low speed (1000×g, 5 min) and the transduction medium was removed and replaced with fresh CD-CHO medium. The cells were transferred to a T-25 mL vented flask and returned to the incubator. Four days after initial infection, the medium was supplemented with 1 µg/mL of blasticidin (Invitrogen, Carlsbad, Calif.). The medium was changed every 3-4 days until the confluency of the CHO-S cells reached approximately 90% and cells began to detach from the flasks. The cells were transferred to shaker flasks for expansion, cell banking and protein production.

Conditioned medium was collected to purify the protein, either mature ADA2 set forth in SEQ ID NO:5 or a mature variant (e.g. set forth in Tables 7-12), each with a FLAG tag. Two to five liters of conditioned medium was harvested and passed over an anti-FLAG M2 affinity resin (Sigma-Aldrich, St. Louis, Mo., Cat. No. A2220). The resin was equilibrated with approximately 10 bed volumes of wash buffer (Tris Buffered Saline (TBS), pH 7.5) at a flow rate of 4 mL/min before loading the conditioned medium. The loaded column was then washed with ~10 bed volumes of TBS and then connected to an AKTA Purifier (GE Healthcare, Pittsburgh, Pa.), and the bound protein was eluted using a low pH buffer (0.1 M of Glycine-HCl at pH 2.7). The fractions were immediately neutralized with 1/10 volume of 1 M Tris-HCl, pH 8.8.

The fractions of purified protein were pooled and dialyzed in 4 liters of PBS with two buffer changes using a Slide-A-Lyzer Dialysis Cassette (20 kD MWCO; Thermo Fisher Scientific, Rockford, Ill.). The dialyzed protein product was then concentrated using an Amicon Ultra centrifugal concentrator (30 kD MWCO; EMD Milipore, Billerica, Mass.) and the final protein concentration determined using the Pierce™ BCA Protein Assay Kit (Thermo Fisher Scientific, Rockford, Ill.). Purity of the preparation was assessed using SDS-PAGE, and adenosine deaminase activity was tested as described below in Example 4.

Purity of the rHuADA2-FLAG protein preparation, as assessed by SDS-PAGE was 95% or greater. The preparation was also characterized by size-exclusion chromatography (SEC), which showed that the rHuADA2-FLAG protein was present as a single molecular weight species with greater than 95% purity as assessed by area under the curve (AUC) calculations.

Alternatively, the wild type rHuADA2 and variants were expressed using the CHO Freedom CHO-S Kit (Invitrogen) according to the manufacturer's specification and purified as described above.

Example 3

Production of Recombinant Human Adenosine Deaminase 1 (rHuADA1)

A. Cloning of Wildtype (WT) ADA1

The human adenosine deaminase 1 (ADA1) gene (nucleic acid sequence set forth in SEQ ID NO:11; encoding the amino acid sequence set forth in SEQ ID NO:12) was amplified and cloned into the pD444-SR: T5-sRBS-ORF (DNA 2.0, Menlo Park, Calif.; Cat. No. FPB-27-444) *E. coli* expression vector, under the control of an Isopropyl-β-D- thiogalactopyranoside (IPTG) inducible promoter (DNA 2.0, Menlo Park, Calif.). The construct also contained a linker (amino acid sequence set forth in SEQ ID NO:64) and a C-terminal Strep-tag (amino acid sequence set forth in SEQ ID NO:65) to facilitate affinity purification of the protein. The amino acid sequence of the encoded ADA1-Strep is set forth in SEQ ID NO:3. In the mature form of the protein, the N-terminal methionine residue is removed, so that the mature ADA1-Strep polypeptide has the amino acid sequence set forth in SEQ ID NO:67 (corresponding to a mature polypeptide sequence set forth in SEQ ID NO:66, without the Strep tag).

B. Generation of ADA1 Variants

This resulting construct encoding the WT rHuADA1-Strep was used to introduce site-specific amino acid substitutions to create ADA1 variant C74S, with numbering based on the mature ADA1 set forth in SEQ ID NO:67 (corresponding to C75S with number based on polypeptide set forth in SEQ ID NO:12). The variant was generated as a candidate to stabilize activity because a solvent exposed cysteine residue in ADA1 could be oxidized in plasma and negatively impact enzymatic activity in the plasma. Site-specific substitution was made using the QuikChange Lightning Multi Site-Directed Mutagenesis Kit (Agilent Technologies, Santa Clara, Calif.; Cat. No. 210514) according to the manufacturer's instructions. In the mature form of the protein, the mature C74S-ADA1-Strep variant has the sequence of amino acids set forth in SEQ ID NO:69 (corresponding to a mature polypeptide sequence set forth in SEQ ID NO:70, without the Strep tag).

C. Expression in *E. coli*

For expression of wildtype ADA1 and variant, the resulting cloned construct was transformed into *Escherichia coli* BL21-DE3 (Calbiochem, San Diego, Calif.). The transformed bacteria were plated onto Luria Broth (LB) agar-ampicilin plates (TekNova, Hollister, Calif.) and single colony selected for large scale culture. The bacteria from the selected colony was grown overnight (37° C., 200 rpm) in LB medium supplemented with the antibiotic carbenicillin (50 μg/mL; EMD Millipore, Billerica, Mass.). The culture was used to seed large shaker cultures. The culture was allowed to grow until it reached an $OD_{600}$ of approximately 0.8 and then expression of protein was induced by the addition of 1 mM IPTG The culture was then transferred to a 25° C. incubator and allowed to grow overnight (~15 hours) with shaking at 200 rpm. The following day, the bacterial cells were centrifuged at 9000×g for 30 min and the cells in the pellet were lysed by sonication using a Branson Sonifier 250 (Emerson, Danbury, Conn.) using repeated pulsing on ice at 20% duty cycle for approximately 5 min. The bacterial lysate was then incubated with lysozyme (100 μg/mL; Sigma-Aldrich, St. Louis, Mo.) and Benzonase (50 U/mL; Sigma-Aldrich, St. Louis, Mo.) for four hours at 4° C. with gentle stirring. The bacterial lysate was centrifuged (5000×g; 45 min) to remove cell debris.

The culture lysate was used to purify the protein, either mature ADA1 set forth in SEQ ID NO:66 or a mature C74S-ADA1 variant set forth in SEQ ID NO:69, each with a Strep tag. The clarified lysate was removed and sterile filtered prior to being loaded onto a StrepTrap™ columns containing StrepTactin™ affinity resins (5 mL capacity; GE Healthcare, Pittsburgh, Pa.). The column was then connected to an AKTA purifier and protein was eluted using a solution of 2.5 mM d-desthiobiotin in buffer (100 mM Tris-HCl, pH 8.0, 150 mM NaCl, 1 mM EDTA). The fractions containing the purified protein were pooled and dialyzed at 4° C. in 4 liters of 1× Phosphate Buffered Saline (PBS) buffer for 4 hours with two buffer changes using a Slide-A-Lyzer Dialysis Cassette (20 kD MWCO; Thermo Fisher Scientific, Rockford, Ill.). The protein preparation was then concentrated using an Amicon Ultra centrifugal concentrator (30 kD MWCO; EMD Milipore, Billerica, Mass.) and the final protein concentration determined using the Pierce™ BCA Protein Assay Kit (Thermo Fisher Scientific, Rockford, Ill.). The purity of the protein preparation, as assessed by SDS-PAGE was 95% or greater.

Example 4

Adenosine Deaminase Enzymatic Activity Test

Adenosine deaminase activity was determined using an adenosine deaminase (ADA) assay kit (Genway, San Diego, Calif.; Cat. No. BQ014EALD) with minor modifications. The ADA assay is based on the enzymatic deamination of adenosine to inosine, which is converted to hypoxanthine by purine nucleoside phosphorylase (PNP). Hypoxanthine is then converted to uric acid and hydrogen peroxide by xanthine oxidase (XOD). Hydrogen peroxide is further reacted with N-Ethyl-N-(2-hydroxy-3-sulfopropyl)-3-methylaniline (EHSPT) and 4-aminoantipyrine (4-AA) in the presence of peroxidase (POD) to generate quinone dye, which is monitored in a kinetic manner.

Briefly, 5 μL samples in duplicates (at appropriate dilutions to measure steady-state, non-saturating enzyme activity) were added to 120 μL R1 reagent (provided by the manufacturer; 50 mM Tris HCL, pH 8.0, 2 mM 4-AA, 0.1 U/mL PNP, 0.2 U/mL XOD, 0.6 U/mL peroxidase) in a 96 well plate, according to manufacturer's instructions. The mixtures were incubated at 37° C. for approximately 5 min and 60 μL of R2 reagent (provided by the manufacturer; 50 mM Tris HCl, pH 4.0, 10 mM Adenosine, 2 mM EHSPT) was added to the mixtures. Then, change in absorbance (AA) at 556 nm over time at 37° C. was measured. One unit of ADA is the amount of ADA that generates one μmole of inosine from adenosine per minute at 37° C. Adenosine deaminase activity in mU/mL was calculated using the following formula:

$$1\ mU/mL = (\Delta A/\min \times T_v)/(S_v \times \epsilon \times 1)$$

where $T_v$=total volume (185 μL), $S_v$=sample volume (5 μL), $\epsilon = 32.2 \times 10^{-3}$ μM$^{-1}$ cm$^{-1}$, l=0.5 cm.

Example 5

In Vitro Plasma Stability of ADA1 Versus ADA2

The enzymatic activity of the purified preparation of WT rHuADA1, rHuADA1-C74S and rHuADA2, before and after incubation in mammalian plasma over a 24 hour time period, was assayed to test the stability of the recombinant protein preparations. The variant rHuADA1-C74S also was tested to determine whether stability in plasma can be improved by substitution of the solvent-exposed cysteine residue.

A. Incubation of Purified rHuADA1 and rHuADA2 Preparations in Plasma

Purified rHuADA1, rHuADA2 and rHuADA1-C74S preparations were individually added to ex vivo 25% BALB/c mouse plasma at a final concentration of 0.17 mg/ml (corresponding to an approximate equivalent dose of 10 mg/kg equivalent in a mouse). The samples were incubated at 37° C. for 24 hours. As a control, proteins were individually incubated at a concentration of 0.17 mg/ml in PBS containing 0.2% BSA (as a stabilizer). At 0, 4 and 24 hours after incubation, 3 small aliquots of each plasma incubated sample and each PBS incubated controls were removed and stored at −20° C. until subsequent analysis.

The stability of the proteins in ex vivo plasma after incubation was determined by comparing the changes in adenosine deaminase enzymatic activity using the method described in Example 4. The molecular weight and stability of the protein also was examined by Western blot to detect any possible protein degradation. Approximately 200 ng of protein were individually assayed using Western blot and the protein bands were detected using ECL (Bio-Rad Laboratories, Hercules, Calif.). Rabbit-anti-human ADA1 (Abcam, Cambridge, Mass.) and goat-anti-rabbit-horseradish peroxidase (HRP) (EMD Millipore, Billerica, Mass.) were used as primary and secondary antibodies, respectively, for rHuADA1. Anti-FLAG-HRP (Abcam) was used to detect rHuADA2.

B. Results 1. rHuADA1 Stability

Table 13 shows the mean and standard deviation (stdev) of the adenosine deaminase activity test of WT rHuADA1 and rHuADA1-C74S. The results show that there was a significant reduction of rHuADA1 activity after a 24-hour incubation in plasma at 37° C. For example, less than 1% of activity was retained after treatment with plasma for 24 hours, whereas greater than 80% of activity was retained when in the PBS/BSA control for the same time period. The observed decrease in activity was not caused by protein degradation, since the protein level was relatively constant at all time-points, as measured by western blot.

The results also show that the solvent-exposed cysteine residue (C74) does not account for the negative impact on enzyme activity in plasma, since similar results were obtained for the C74S variant. For example, despite not possessing the exposed thiol at position 74, the variant still showed a strong decrease in activity after a 24 hour incubation in plasma. The results showed that after 24 hours, about 1% of activity of the variant enzyme was retained after treatment with plasma, whereas greater than 80% of activity was retained when in the PBS/BSA control.

Normally, ADA1 is expressed in an intracellular manner and is known to translocate and associate with extracellular dipeptidyl peptidase-4 (DPPIV). These results demonstrate that outside of this environment, ADA1 is rapidly inactivated by exposure to plasma, and that the mutation of the surface exposed cysteine 74 did not prevent inactivation.

TABLE 13 rHuADA1 and rHuADA1-C74S activity after serum incubation

|  | Time (hr) | PBS incubated mean (mU/mL) | Plasma incubated mean (mU/mL) | PBS incubated Stdev | Plasma incubated Stdev |
| --- | --- | --- | --- | --- | --- |
| rHuADA1 | 0 | 61,077.0 | 71,663.6 | 2,352.2 | 2,461.4 |
|  | 4 | 59,544.8 | 46,772.1 | 3,352.5 | 4,645.3 |
|  | 24 | 50,287.9 | 673.6 | 700.5 | 135.7 |
| rHuADA1-C74S | 0 | 43,031.9 | 59,632.4 | 2,695.6 | 4,890.5 |
|  | 4 | 44,682.4 | 39,636.7 | 3,739.6 | 1,671.4 |
|  | 24 | 37,492.2 | 616.6 | 751.4 | 44.7 |

2. rHuADA2 Stability

Table 14 below shows the mean and standard deviation (stdev) of the adenosine deaminase activity test of rHuADA2 after a 24 hour incubation with plasma. In contrast to the results for ADA1, the results show that ADA2 was substantially more stable in plasma after a 24-hour incubation at 37° C. For example, about 65% of activity was retained after treatment with plasma for 24 hours, whereas no change in activity was observed when treated with PBS/BSA control for the same time period.

TABLE 14 rHuADA2 activity after serum incubation

| Time (hr) | PBS incubated mean (mU/mL) | Plasma incubated mean (mU/mL) | PBS incubated Stdev | Plasma incubated Stdev |
| --- | --- | --- | --- | --- |
| 0 | 9,140.5 | 10,988.4 | 1,058.8 | 1,827.9 |
| 4 | 9,584.6 | 10,936.1 | 1,697.8 | 1,784.5 |
| 24 | 9,832.1 | 7,147.8 | 1,310.6 | 1,014.8 |

Example 6

Effect of ADA2 on Adenosine-Mediated Modulation of Immune Response

Extracellular adenosine is an inflammatory modulator of immune responses, and elevated levels of adenosine in the tumor microenvironment could reduce and/or inhibit the effector function of T and NK cells, thus favoring tumor growth. To assess if effects of adenosine can be monitored by assessing immune cell proliferation, proliferation experiments were performed with a mixture of NK and T cells (NK/T). In addition, experiments were performed to assess if rHuADA2, through its enzymatic conversion of adenosine to inosine, can rescue the immune cells from adenosine-mediated proliferation inhibition.

A. Assessing Effects of Adenosine on NK/T Cell Proliferation

A mixture of NK and T cells (NK/T) were prepared from healthy donor's peripheral blood mononuclear cells (PBMC). Briefly, $10 \times 10^7$ HumanPBMCs were cultured for 6-7 days in Stem cell growth medium (SCGM; Order No. 20802-0500, CellGenix, Freiburg, Germany) with 5% human serum from donors with blood type AB (human AB serum; Cat. No. 35-060-C1, Mediatech, Mannassas, Va.) in the presence of 20 ng/mL anti-CD3 eBioscience, San Diego, Calif.; Cat. No. 16-0039) and 500 IU/mL recombinant human interleukin 2 (rhIL-2; Cat. No. 200-02, PeproTech, Rocky Hill, N.J.). The cells were then cultured for an additional 2-3 weeks in SCGM in the presence of 500 IU/mL rhIL-2. NK/T cells cultured for 2-4 weeks were used in experiments.

To test the adenosine-mediated inhibition of NK/T cells proliferation, NK/T cells (10,000 cells/well) were plated in a 96 well white plate with clear bottoms in 200 µL volume. The cells were treated with 20 µL adenosine (SKU No. A925, Sigma Aldrich) at concentrations resulting from a 3-fold dilution series starting at 1 mM, i.e. 1 mM, 300 µM, 100 µM, 30 µM, 10 µM, 3 µM, 1 µM, 0.3 µM and 0.1 µM. The NK/T cells were allowed to grow for 5 days in a humidified tissue culture incubator at 37° C. with 5% $CO_2$. After 5 days of treatment, the cells were centrifuged in a 96 well plate at 12,000 rpm for 5 min. 100 µL of medium was removed from each well of cells, followed by addition of 100 µL of Cell Titer Glow (CTG) reagent (Cat. No. G7570, Promega, Madison, Wis.) and incubated at room temperature for 15 min before measuring luminescence on the SpectraMax M3 plate reader according to the manufacturer's instructions. The mean cell survival (%) was determined by comparison of the measured luminescence to control cells not treated with adenosine The results are set forth in Table 15. The results showed that treatment of the NK/T cells with adenosine for 5 days resulted in a dose-dependent adenosine inhibition of NK/T cells proliferation. The $IC_{50}$, the concentration of adenosine where the response is reduced by half, was 16.2

TABLE 15

Adenosine-mediated inhibition of NK/T proliferation

| Adenosine Concentration (µM) | Mean Cell survival (%) | Standard Deviation |
|---|---|---|
| 1000 | 15.82 | 0.44 |
| 300 | 13.65 | 1.04 |
| 100 | 26.01 | 1.51 |
| 30 | 36.84 | 0.96 |
| 10 | 70.33 | 1.33 |
| 3 | 110.07 | 2.07 |
| 1 | 121.11 | 1.8 |
| 0.3 | 101.19 | 1.14 |
| 0.1 | 106.67 | 1.21 |

B. Assessing Effects of ADA2 on Adenosine-Mediated Inhibition of Proliferation of NK/T Cells rHuADA2 was tested to assess whether it can reverse the adenosine-mediated inhibition of NK/T cell proliferation at 1 mM adenosine. NK/T cells (10,000 cells/well) were plated in 96 well white plates with clear bottoms in a total volume of 180 µL. The cells were treated with 20 µL rHuADA2 at concentrations resulting from 3-fold dilution series, to give a final rHuADA2 concentration of 100 nM, 30 nM, 10 nM, 3 nM, 1 nM, 0.3 nM, 0.1 nM, and 0.03 nm, and then each well also was treated with 20 µL of adenosine at 1 mM. After treatment, the NK/T cells were cultured, processed and luminescence measured as described above. The mean cell survival (%) was determined by comparison of the measured luminescence to control cells not treated with adenosine or rHuADA2.

The results are set forth in Table 16. The results showed that rHuADA2 rescued the adenosine-mediated inhibition of NK/T cell proliferation, in a dose-dependent manner. The $EC_{50}$, the concentration of rHuADA2 that induces a response halfway between the baseline and maximum, was 8.5 nM.

TABLE 16

ADA2 rescue of adenosine-mediated proliferation inhibition (1 mM adenosine)

| rHuADA2 Conc (nM) | Mean cell survival (%) | Standard Deviation |
|---|---|---|
| 100 nM | 120.6 | 2.76 |
| 30 nM | 105.5 | 2.86 |
| 10 nM | 83.82 | 2.17 |
| 3 nM | 41.98 | 0.9 |
| 1 nM | 25.73 | 0.3 |
| 0.3 nM | 18.33 | 0.12 |
| 0.1 nM | 18.4 | 0.72 |
| 0.03 nM | 16.03 | 0.47 |

Experiments also were performed to assess the effect of rHuADA2 to reverse adenosine-mediated inhibition of NK/T cell proliferation at various concentrations of adenosine. The experiments were conducted in a similar manner as described above, with final adenosine concentration of 1 mM, 100, 50, or 25 µM and final rHuADA2 concentration of 100 nM, 30 nM, 10 nM, 3 nM, 1 nM, 0.3 nM, 0.1 nM, and 0.03 nM.

The results are set forth in Table 17. Similar to the results above, a dose-dependent rescue of NK/T cells proliferation by rHuADA2 was observed at varying adenosine concentrations. The $EC_{50}$ values for rHuADA2 at different fixed concentrations of adenosine is set forth in Table 18. The results show that adenosine inhibits NK/T cells proliferation and that the addition of rHuADA2 can rescue human NK/T cells from the adenosine-mediated inhibition of proliferation.

TABLE 17

ADA2 rescue of adenosine-mediated proliferation inhibition at varying adenosine and ADA2 concentrations

| ADA2 (nM) | 1 mM Adenosine | | 100 µM Adenosine | | 50 µM Adenosine | | 25 µM Adenosine | |
|---|---|---|---|---|---|---|---|---|
| | MS % | SD | MS % | SD | MS % | SD | MS % | SD |
| 100 nM | 96.3 | 1.2 | 109 | 2.3 | 116.9 | 1.5 | 120.6 | 2.5 |
| 30 nM | 79.1 | 1.5 | 114.4 | 2.6 | 114.7 | 2.3 | 117.2 | 1.3 |
| 10 nM | 67.1 | 1.4 | 108.3 | 2.1 | 105.9 | 1.2 | 121.2 | 1.1 |
| 3 nM | 41.4 | 1 | 91.6 | 2.3 | 94 | 0.9 | 107.4 | 1.1 |
| 1 nM | 22.6 | 0.5 | 71.7 | 1.7 | 80.2 | 0.6 | 99.3 | 1.5 |
| 0.3 nM | 18.3 | 0.1 | 57.8 | 0.7 | 64.8 | 0.8 | 90.5 | 1 |
| 0.1 nM | 16.3 | 0.2 | 43.8 | 0.8 | 76.6 | 0.9 | 89.6 | 0.9 |
| 0.03 nM | 15.6 | 0.2 | 45.9 | 1.6 | 71.2 | 0.5 | 81.7 | 1 |

MS % = mean survival (%)
SD—standard deviation

TABLE 18

$EC_{50}$ values for ADA2 and various concentrations of Adenosine

| Adenosine Concentration | $EC_{50}$ for rHuADA2 |
|---|---|
| 1 mM | 7.2 nM |
| 100 µM | 1.5 nM |
| 50 µM | 3.8 nM |
| 25 µM | 1.5 nM |

Example 7

Identification of ADA2 Heparin Binding Site Variants that Exhibit Reduced Heparin Binding Selected candidate variants described in Table 7 above, that have an amino acid substitution in a residue that involved in heparin binding, were screened to assess if any exhibit attenuated heparin binding. Table 19 lists the variants that were tested. Heparin binding was assessed using heparin-affinity chromatography and/or using an enzyme-linked immunosorbant assay (ELISA). In addition, the adenosine deaminase activity of variants also was assessed. To perform the experiments, purified WT rHuADA2 and tested variants were prepared at 0.3 mg/mL concentration to normalize the amount of protein in each experiment.

A. Heparin Binding

1. Heparin-Affinity Chromatography

To assess binding of variants to heparin, heparin-affinity chromatography was employed to identify heparin-bound variants. Heparin binding was tested by mixing 35 µL of rHuADA2 WT and variants with 20 µL heparin-Sepharose™ resin (GE Healthcare, Pittsburgh, Pa.; Cat. No. 17-0998-01), followed by incubating at room temperature for 30 min. The mixture was then centrifuged through a 0.22 µm centrifuge filter and the flow-through, containing the unbound protein, was collected for analysis on an SDS- PAGE gel. 35 μL of 1.5 M NaCl was added to heparin-Sepharose resin and incubated at room temperature (RT) for 10 min to elute the remaining heparin-bound protein from the heparin-Sepharose. Samples of purified WT rHuADA2 and tested variants, before and after mixing with the heparin-Sepharose resin, were analyzed by SDS-PAGE to compare the degree of heparin binding.

The results are set forth in Table 19. The results show that a reduced elution of protein was achieved for 16 out of the 25 tested variants, indicating that these variants exhibit attenuated heparin binding compared to WT rHuADA2. The other variants exhibited elution similar to WT rHuADA2.

TABLE 19

Heparin Column Binding of ADA2 HBP variants

| Substitution (Zavialov numbering) | Substitution (mature numbering) | Heparin Column Binding |
|---|---|---|
| K14A | K11A | Similar to WT |
| K14D | K11D | Similar to WT |
| K14E | K11E | Similar to WT |
| K16A | K13A | Similar to WT |
| K16D | K13D | Similar to WT |
| K16E | K13E | Similar to WT |
| K374A | K371A | Reduced |
| K374D | K371D | Reduced |
| K374E | K371E | Reduced |
| K375A | K372A | Reduced |
| K375D | K372D | Reduced |
| K375E | K372E | Reduced |
| K455A | K452A | Similar to WT |
| K455D | K452D | Similar to WT |
| K455E | K452E | Reduced |
| R23A | R20A | Reduced |
| R23D | R20D | Reduced |
| R23E | R20E | Reduced |
| R369A | R366A | Reduced |
| R369D | R366D | Reduced |
| R369E | R366E | Reduced |
| K14A/R23A | K11A/R20A | Reduced |
| K14A/R23A/K374A | K11A/R20A/K371A | Reduced |
| R23A/K374A | R20A/K371A | Reduced |
| K14A/K374A | K11A/K371A | Reduced |

2. ELISA Assay for Heparin Binding Property

An enzyme-linked immunosorbant assay (ELISA) using a heparin coated microtiter plate was performed to confirm the attenuated heparin binding properties of the rHuADA2 HBP variants screened above. A 96-well plate was coated with 100 μL of 200 μg/mL heparin sodium salt (Calibochem, EMD Milipore, Billerica, Mass.; Cat. No. 375095) in $Na_2CO_3$ buffer (pH 9.6), overnight at 4° C. The wells were blocked with 5% milk in PBS, and washed 6 times with PBS. 3 μM of select rHuADA2 variants (see Table 20), WT rHuADA2 (positive control) and WT rHuADA1 (negative control) were added to the wells individually and incubated for 2 hours at room temperature, followed by washing 6 times with PBS. 100 μL of 1:1000 diluted horseradish peroxidase (HRP)-anti-FLAG antibody (Abcam, Cambridge, UK; Cat. No. Ab1238) was added to the wells to detect binding and incubated at room temperature for 1 hour. The ELISA reactions were developed by adding the 3,3',5,5'-Tetramethylbenzidine (TMB) substrate solution (Pierce, Thermo Fisher Scientific, Rockford, Ill.) according the manufacturer's instructions and reading the optical density at 450 nm ($OD_{450}$) on a plate reader.

The results are set forth in Table 20, which sets forth the average $OD_{450}$ reading and the standard deviation (Stdev) for tested variants. The results showed that WT ADA2 had the highest measured OD of any tested protein indicating binding to heparin, while the negative control ADA1 did not result in a detectable signal. The results showed that all tested variants, which are variants identified above that exhibit reduced binding to heparin, exhibit a lower measured OD reading than WT ADA2 and hence reduced binding to heparin-coated plates. Hence, consistent with the results above, the results showed attenuated binding to heparin, compared to wild-type human rHuADA2.

TABLE 20

Heparin Binding ELISA assay of selected ADA2 HBP variants

| | Substitution (Zavialov numbering) | Substitution (mature numbering) | Average $OD_{450}$ | Stdev |
|---|---|---|---|---|
| Set 1 | K374D | K371D | 0.15 | 0.02 |
| | K374E | K371E | 0.11 | 0.01 |
| | K375D | K372D | 0.2 | 0.07 |
| | K375E | K372E | 0.21 | 0.05 |
| | WT ADA2 | WT ADA2 | 0.49 | 0.02 |
| | WT ADA1 | WT ADA1 | 0.07 | 0.01 |
| Set 2 | K455E | K452E | 0.26 | 1 |
| | R23E | R20E | 0.2 | 0 |
| | R369E | R366E | 0.18 | 0.04 |
| | R23A/R374A | R20A/R371A | 0.17 | 0.08 |
| | WT ADA2 | WT ADA2 | 0.55 | 0.15 |
| | WT ADA1 | WT ADA1 | 0.06 | 0.01 |

B. Adenosine Deaminase Activity Assay

Adenosine deaminase activity of WT rHuADA2 and variants tested above were determined using the adenosine deaminase activity (ADA) assay described in Example 4. Activity was assessed on purified rHuADA2 WT and variants that were diluted to 5 μg/mL, and then serially diluted 2 fold to generate 4 measurements.

Table 21 sets forth the results. The last column sets forth the relative enzymatic activity (% activity vs. WT) compared to the rHuADA2 WT.

The results show that most variants that exhibit reduced heparin binding exhibit either similar or increased adenosine deaminase activity compared to WT ADA2. In particular, variants R23E, K374D, K374E, K375D, K375E, K455D, K455E, and R369E by Zavialov numbering (R20E, K371D, K371E, K372D, K372E, K452D, K452E and R366E, respectively, by mature numbering) not only show attenuated heparin binding, but also exhibit improved enzymatic activity.

In contrast, variants R23A, R23D and R369A (R20A, R20D and R366A, respectively, by mature numbering) exhibit reduced heparin binding, but also exhibit reduced adenosine deaminase activity.

The results show that K14E variant (K11E by mature numbering) and K455D variant (K452D by mature numbering) exhibit improved enzymatic activity relative to the WT rHuADA2, while the heparin binding property was not attenuated.

TABLE 21

Adenosine Deaminase Activity of ADA2 variants

| Substitution (Zavialov numbering) | Substitution (mature numbering) | ΔA/min | mU/mL | stdev | % activity vs. WT |
|---|---|---|---|---|---|
| K14A | K11A | 4.9 | 11.4 | 1.2 | 14.6 |
| K14D | K11D | 8.1 | 18.7 | 0.2 | 24 |
| K14E | K11E | 38.8 | 89.1 | 2.8 | 114.2 |
| K16A | K13A | 12.2 | 28 | 1.8 | 35.9 |

TABLE 21-continued

Adenosine Deaminase Activity of ADA2 variants

| Substitution (Zavialov numbering) | Substitution (mature numbering) | ΔA/ min | mU/ mL | stdev | % activity vs. WT |
|---|---|---|---|---|---|
| K16D | K13D | 29.3 | 67.3 | 18.1 | 86.3 |
| K16E | K13E | 7.1 | 16.3 | 2.4 | 20.9 |
| K374A | K371A | 25.8 | 59.2 | 16.3 | 75.9 |
| K374D | K371D | 117.3 | 269.8 | 6.4 | 345.9 |
| K374E | K371E | 136.5 | 313.8 | 17 | 402.3 |
| K375A | K372A | 35.5 | 81.8 | 15.4 | 104.8 |
| K375D | K372D | 53.7 | 123.5 | 10.9 | 158.3 |
| K375E | K372E | 47 | 108.1 | 10 | 138.6 |
| K455A | K452A | 6.1 | 14 | 2.8 | 18 |
| K455D | K452D | 42.6 | 97.9 | 12.6 | 125.5 |
| K455E | K452E | 55.4 | 127.3 | 6.1 | 163.2 |
| R23A | R20A | 23.2 | 53.3 | 4.8 | 68.4 |
| R23D | R20D | 6.9 | 15.9 | 4.2 | 20.3 |
| R23E | R20E | 70.2 | 161.6 | 26.3 | 207.1 |
| R369A | R366A | 14.9 | 34.3 | 5.5 | 44 |
| R369D | R366D | 34.9 | 80.2 | 3.6 | 102.8 |
| R369E | R366E | 50.4 | 115.9 | 28.9 | 148.5 |
| K14A/R23A | K11A/R20A | 42.1 | 96.9 | 0.7 | 124.2 |
| K14A/R23A/K374A | K11A/R20A/K371A | 31.7 | 72.8 | 10.1 | 93.3 |
| R23A/K374A | R20A/K371A | 51.1 | 117.6 | 7.1 | 150.7 |
| K14A/K374A | K11A/K371A | 34.1 | 78.4 | 2.2 | 100.5 |
| WT ADA2 | WT ADA2 | 33.9 | 78 | 1.2 | 100 |

Example 8

PEGylation of rHuADA2 and Assessment of Adenosine Deaminase Activity and Heparin Binding rHuADA2, K374D-ADA2 variant (K371D by mature numbering) or R23E-ADA2 variant (R20E by mature numbering) were PEGylated on surface exposed lysines by reaction with linear PEG-20K. The PEGylated-rHuADA2 or variants were assessed for heparin binding and adenosine deaminase activity.

A. PEGylation

To PEGylate the enzyme, 3 mg/mL WT rHuADA2, rHuADA2-K374D (K371D by mature numbering) or rHuADA2-R23E (R20E by mature numbering) variants were each individually mixed with linear PEG-20K (Jen-Kem Technology, Plano, Tex.; Cat. No. M-SCM-20K) at 1:15 molar ratio and incubated at 4° C. for 16 hours. The reaction mixture was centrifuged through a 0.22 μm centrifuge filter and the flow-through containing the PEGylated enzyme was collected.

The extent of PEGylation was assessed by SDS-PAGE analysis. The results show that at least 80% of the WT rHuADA2, rHuADA2-K374D (K371D by mature numbering), and rHuADA2-R23E (R20E by mature numbering) were PEGylated under the reaction conditions, as indicated by a decrease in intensity of the unmodified rHuADA2 band accompanied by the appearance of multiple larger bands representing the PEGylated rHuADA2 molecules.

B. Heparin Binding ELISA

Heparin binding of PEGylated rHuADA2 or variants was assessed by capture ELISA. Binding of rHuADA1 was assessed as a negative control. 100 μL of 0.2 mg/mL biotin-heparin (Sigma-Aldrich, St. Louis, Mo.; Cat No. B9806-10MG) was added to a streptavidin coated 96-well plate (Thermo Fisher Scientific, Rockford, Ill.; Cat. No. 15520), and incubated at room temperature for 1 hour. The plate was washed 6 times with PBS. Then, 150 μL of 1 PEGylated rHuADA2 was added to the heparin coated plate, titrated in 3× serial dilutions, and incubated at room temperature for 2 hours. The plate was then washed 6 times with PBS. A 1000× dilution of goat HRP-anti-FLAG pAb (Abcam, Cambridge, UK; Cat. No. Ab1238) was added to the ELISA plate and incubated at room temperature for 1 hour. The ELISA plate was then washed 6 times with phosphate buffered saline with Tween (PBST) and developed with the 3,3',5,5'-Tetramethylbenzidine (TMB) substrate solution (Pierce, Thermo Fisher Scientific, Rockford, Ill.) according the manufacturer's instructions and reading the optical density at 450 nm ($OD_{450}$) on a plate reader.

Table 22 sets forth the average $OD_{450}$ reading and the standard deviation (Stdev) from the heparin binding capture ELISA assay of PEGylated rHuADA2 wild-type and variants. The results show that PEGylated rHuADA2 and variants have a significant reduction in heparin binding. For PEGylated rHuADA2-K374D (K371D by mature numbering) and rHuADA2-R23E (R20E by mature numbering) variants, PEGylation conferred additional reduction in heparin binding property compared to the non-PEGylated forms with reduced heparin binding. Thus, these results indicate that modification of the rHuADA2 protein with the PEG moiety reduces heparin binding by steric blockade and/or alteration of electrostatic charges on the surface of rHuADA2.

TABLE 22

Heparin Binding ELISA assay of PEGylated ADA2 WT and variants

| Variant (Zavialov numbering) | Variant (mature numbering) | Average $OD_{450}$ | Stdev |
|---|---|---|---|
| K374D | K371D | 0.87 | 0.03 |
| PEG-K374D | PEG-K371D | 0.15 | 0.05 |
| R23E | R20E | 0.71 | 0.04 |
| PEG-R23E | PEG-R20E | 0.55 | 0.02 |
| WT ADA2 | WT ADA2 | 2.31 | 0.01 |
| PEG-WT ADA2 | PEG-WT ADA2 | 0.75 | 0.04 |
| WT ADA1 | WT ADA1 | <0.02 | 0 |

C. Adenosine Deaminase Activity Assay

Adenosine deaminase activity of PEGylated rHuADA2 and variants was assessed using the method described in Example 4, and compared to the activity of the corresponding non-PEGylated form.

The results are set forth in Table 23. The results show that PEGylated WT rHuADA2 had comparable adenosine deaminase activity compared to the non-PEGylated form. Similarly, the PEGylated rHuADA2-K374D (K371D by mature numbering) and rHuADA2-R23E (R20E by mature numbering) variants also showed comparable adenosine deaminase activity compared to the non-PEGylated forms. Although WT rHuADA2 contains 32 lysine residues as a monomer, and 64 lysine residues as a dimer, PEGylation at the lysine residues had no impact on the adenosine deaminase activity of rHuADA2.

TABLE 23

Adenosine Deaminase Activity of PEGylated ADA2 WT and variants

| Variant (Zavialov numbering) | Variant (mature numbering) | mU/mL | stdev | % of WT |
|---|---|---|---|---|
| K374D | K371D | 162.9 | 2.2 | 134 |
| R23E | R20E | 129.9 | 0.4 | 106.8 |
| WT | WT | 121.6 | 2.3 | 100 |
| PEG-K374D | PEG-K371D | 142 | 7.1 | 116.8 |

TABLE 23-continued

Adenosine Deaminase Activity of PEGylated ADA2 WT and variants

| Variant (Zavialov numbering) | Variant (mature numbering) | mU/mL | stdev | % of WT |
|---|---|---|---|---|
| PEG-R23E | PEG-R20E | 115.6 | 3.9 | 95.1 |
| PEG-WT | PEG-WT | 124.2 | 5.5 | 102.2 |

D. Conclusion

The results of the experiments demonstrate that PEGylation of rHuADA2 variants reduces heparin binding in addition to the attenuated heparin binding resulting from the amino acid substitution, but without loss of adenosine deaminase activity. Thus, the results show that PEGylation of heparin-binding variants can improve the pharmacokinetic properties of the rHuADA2 variants without affecting the adenosine deaminase activity. PEGylation can be used in place of mutation to attenuate heparin binding.

Example 9

In Vivo Pharmacokinetic Analysis of rHuADA2, ADA2 Variants, and PEGylated Forms

The pharmacokinetics (PK) of non-PEGylated and PEGylated forms of WT rHuADA2, ADA2-K374D and ADA2-R23E variants by Zavialov numbering (K371D and R20E, respectively, by mature numbering) were analyzed in an immunocompetent mouse model.

A. Study Design

Fifty four (54) male BALB/c mice were divided into six (6) dosing groups, and were further divided into three (3) groups each for sampling of blood at different time points. Thus, the mice were randomized into eighteen (18) groups total. Mice were weighed prior to the start of the study, and randomized into the 18 groups based upon their body weights. In each sampling group, three groups of (3) mice were used for dosing each test article to prevent oversampling of the blood from the animals. For measurement of baseline ADA2 levels, a blood sample was obtained from 12 randomly chosen mice and plasma was prepared using the anti-coagulant potassium ($K_3$) ethylene diamine tetraacetic acid ($K_3$-EDTA). All blood was collected by submandibular venipuncture.

Each mouse was injected by intravenous tail-vein injection with a 7.5 mg/kg dose of one of six ADA2 test article as set forth in Table 24, i.e. rHuADA2-K374D (K371D by mature numbering), PEG-rHuADA2-K374D (PEG-K371D by mature numbering), rHuADA2-R23E (R20E by mature numbering), PEG-rHuADA2-R23E (PEG-R20E by mature numbering), or WT ADA2 and PEG-WT ADA2. PEGylated ADA2 variants were prepared using the PEGylation method as described in Example 8.A. The concentration of each test article was 1.5 mg/mL, which resulted in a dose volume range from 93-119 µL depending on the body weight (BW) of the mouse. Dose volumes and body weights for individual animals are provided in Table 25.

Blood was collected at designated sampling time points from appropriate groups of mice as indicated below in Table 24 and kept on ice until plasma preparation. Plasma was prepared by centrifuging the blood (500×g for 5 min at 4° C.), transferring the plasma to a fresh tube and immediately freezing at −80° C. until the adenosine deaminase activity assay. Adenosine deaminase activity was determined as described in Example 4. The half-life, or time taken for the activity of ADA2 proteins to be reduced by half, was calculated. Also, total exposure was measured by calculating the Area Under the Concentration-time Curve (AUC).

TABLE 24

Pharmacokinetics Study Design for PEGylated ADA2 WT and variants

| Group # | Test Article (ZavialoNo.) | (Mature No.) | No. of Animals | Dose | Blood Collection Time points post dosing (hours) |
|---|---|---|---|---|---|
| 1 | K374D | K371D | 3 | 7.5 mg/kg | 0.25, 2 |
| 2 | | | 3 | | 1, 8 |
| 3 | | | 3 | | 4, 24 |
| 4 | PEG-K374D | PEG-K371D | 3 | 7.5 mg/kg | 0.25, 2 |
| 5 | | | 3 | | 1, 8 |
| 6 | | | 3 | | 4, 24 |
| 7 | R23E | R20E | 3 | 7.5 mg/kg | 0.25, 2 |
| 8 | | | 3 | | 1, 8 |
| 9 | | | 3 | | 4, 24 |
| 10 | PEG-R23E | PEG-R20E | 3 | 7.5 mg/kg | 0.25, 2 |
| 11 | | | 3 | | 1, 8 |
| 12 | | | 3 | | 4, 24 |
| 13 | WT ADA2 | WT ADA2 | 3 | 7.5 mg/kg | 0.25, 2 |
| 14 | | | 3 | | 1, 8 |
| 15 | | | 3 | | 4, 24 |
| 16 | PEG-WT | PEG-WT | 3 | 7.5 mg/kg | 0.25, 2 |
| 17 | ADA2 | ADA2 | 3 | | 1, 8 |
| 18 | | | 3 | | 4, 24 |

TABLE 25

Body weight and dosing for pharmacokinetics analysis of PEGylated ADA2 WT and variants

| Test Article (Zavialov numbering) | (Mature numbering) | Group # | Animal ID# | BW | mg of test article | vol (µL) |
|---|---|---|---|---|---|---|
| K374D | K371D | 1 | 817 | 17.7 | 0.1328 | 89 |
| | | | 850 | 21 | 0.1575 | 105 |
| | | | 832 | 23.7 | 0.1778 | 119 |
| | | 2 | 822 | 18.6 | 0.1395 | 93 |
| | | | 830 | 21 | 0.1575 | 105 |
| | | | 819 | 23.7 | 0.1778 | 119 |
| | | 3 | 821 | 18.9 | 0.1418 | 95 |
| | | | 812 | 21.1 | 0.1583 | 106 |
| | | | 844 | 23.3 | 0.1748 | 117 |
| PEG-K374D | PEG-K371D | 4 | 823 | 19.2 | 0.144 | 96 |
| | | | 801 | 20.9 | 0.1568 | 105 |
| | | | 848 | 22.8 | 0.171 | 114 |
| | | 5 | 841 | 19.3 | 0.1448 | 97 |
| | | | 836 | 21.1 | 0.1583 | 106 |
| | | | 837 | 22.8 | 0.171 | 114 |
| | | 6 | 826 | 19.7 | 0.1478 | 99 |
| | | | 835 | 20.8 | 0.156 | 104 |
| | | | 853 | 22.6 | 0.1695 | 113 |
| R23E | R20E | 7 | 828 | 19.8 | 0.1485 | 99 |
| | | | 807 | 21.2 | 0.159 | 106 |
| | | | 834 | 22.4 | 0.168 | 112 |
| | | 8 | 820 | 19.9 | 0.1493 | 100 |
| | | | 840 | 20.7 | 0.1553 | 104 |
| | | | 839 | 22.3 | 0.1673 | 112 |
| | | 9 | 810 | 20 | 0.15 | 100 |
| | | | 809 | 21.2 | 0.159 | 106 |
| | | | 842 | 22.2 | 0.1665 | 111 |
| PEG-R23E | PEG-R20E | 10 | 815 | 20 | 0.15 | 100 |
| | | | 813 | 20.6 | 0.1545 | 103 |
| | | | 827 | 22.2 | 0.1665 | 111 |
| | | 11 | 824 | 20 | 0.15 | 100 |
| | | | 852 | 21.2 | 0.159 | 106 |
| | | | 833 | 22.1 | 0.1658 | 111 |

TABLE 25-continued

Body weight and dosing for pharmacokinetics
analysis of PEGylated ADA2 WT and variants

| Test Article (Zavialov numbering) | Test Article (Mature numbering) | Group # | Animal ID# | BW | mg of test article | vol (μL) |
|---|---|---|---|---|---|---|
| | | 12 | 825 | 20 | 0.15 | 100 |
| | | | 808 | 20.6 | 0.1545 | 103 |
| | | | 845 | 22 | 0.165 | 110 |
| WT ADA2 | WT ADA2 | 13 | 838 | 20 | 0.15 | 100 |
| | | | 818 | 21.3 | 0.1598 | 107 |
| | | | 843 | 21.9 | 0.1643 | 110 |
| | | 14 | 846 | 20 | 0.15 | 100 |
| | | | 814 | 20.5 | 0.1538 | 103 |
| | | | 805 | 21.8 | 0.1635 | 109 |
| | | 15 | 849 | 20 | 0.15 | 100 |
| | | | 851 | 21.3 | 0.1598 | 107 |
| | | | 803 | 21.8 | 0.1635 | 109 |
| PEG-WT ADA2 | PEG-WT ADA2 | 16 | 811 | 20.2 | 0.1515 | 101 |
| | | | 829 | 20.4 | 0.153 | 102 |
| | | | 831 | 21.7 | 0.1628 | 109 |
| | | 17 | 802 | 20.3 | 0.1523 | 102 |
| | | | 854 | 21.4 | 0.1605 | 107 |
| | | | 804 | 21.7 | 0.1628 | 109 |
| | | 18 | 806 | 20.3 | 0.1523 | 102 |
| | | | 847 | 20.3 | 0.1523 | 102 |
| | | | 816 | 21.5 | 0.1613 | 108 |

B. Results

1. Pharmacokinetics of Non-PEGylated rHuADA2 WT and Variants

The pharmacokinetics (PK) properties of WT rHuADA2 compared to variants ADA2-K374D and ADA2-R23E by Zavialov numbering (K371D and R20E, respectively, by mature numbering) are set forth in Tables 26 and 27. Table 26 sets forth the total exposure measured using an Area Under the Curve (AUC) calculation and Table 27 sets forth the half-life ($t_{1/2}$). The results show that each of the variants exhibited improved pharmacokinetic parameters compared to the wildtype ADA2. For example, variant rHuADA2-R23E (R20E by mature numbering) exhibited an AUC that was 19% higher than for WT rHuADA2 and a half-life that was 119% longer than WT rHuADA2. Variant rHuADA2-K374D, exhibited an AUC that was 128% higher than for WT rHuADA2 and a half-life that was 230% longer than for WT rHuADA2.

TABLE 26

Comparison of Total Exposure - Area under the Curve (AUC): ADA2 WT and HBP variants

| Test Article (Zavialov numbering) | Test article (Mature numbering) | AUC (mU * h)/mL | Percent increase in AUC compared to WT ADA2 |
|---|---|---|---|
| WT | WT | 32,883 | — |
| R23E | R20E | 39,033 | 19 |
| K374D | K371D | 74,983 | 128 |

TABLE 27

Comparison of half-life ($t_{1/2}$): ADA2 WT and HBP variants

| Test Article (Zavialov numbering) | Test article (Mature numbering) | Half life slow ($t_{1/2}$) (min) | Percent increase in $t_{1/2}$ compared to WT ADA2 |
|---|---|---|---|
| WT | WT | 69 | — |
| R23E | R20E | 151 | 119 |
| K374D | K371D | 228 | 230 |

2. Pharmacokinetics of PEGylated rHuADA2 WT and Variants

The pharmacokinetics (PK) properties of native and PEGylated WT rHuADA2 compared to PEGylated forms of variants, PEG-R23E (R20E by mature numbering) and PEG-K374D (K371D by mature numbering), are set forth in Tables 28 and 29. Table 28 sets forth the total exposure measured using an Area Under the Curve (AUC) calculation and Table 29 sets forth the half-life ($t_{1/2}$).

For wildtype ADA2, the results show that PEGylation substantially improves the pharmacokinetic profile. The results show that PEG-WT ADA2 exhibits an AUC that was 4291% higher than the non-PEGylated WT ADA2 and a half-life that was 1078% longer than the non-PEGylated WT ADA2. Likewise, PEGylation of the variant forms also resulted in improved pharmacokinetics compared to non-PEGylated forms. Thus, for both of the PK components measured, AUC and $t_{1/2}$, PEGylation led to improved PK values compared to the non-PEGylated forms.

The results also show that that the PEGylated forms of ADA2 variants also exhibit improvements in one or both PK components compared to PEG-WT ADA2, although these improvements were greater for the variant PEG-K374D (K371D by mature numbering) than for PEG-R23E (R20E by mature numbering). For example, PEG-R23E (R20E by mature numbering), exhibited an AUC that was 4271% higher (compared to 4291% for PEG-WT ADA2) than the non-PEGylated WT ADA2 and a half-life that was 1420% longer (compared to 1078% for PEG-WT ADA2) than the non-PEGylated WT ADA2. In contrast, PEG-K374D (K371D by mature numbering), exhibited an AUC that was 8187% higher (compared to 4291% for PEG-WT ADA2) than the non-PEGylated WT ADA2 and a half-life that was 1791% longer (compared to 1078% for PEG-WT ADA2) than the non-PEGylated WT ADA2.

TABLE 28

Comparison of Total Exposure - Area under the Curve (AUC): PEGylated ADA2 WT and HBP variants

| Test Article (Zavialov numbering) | Test article (Mature numbering) | AUC (mU * h)/mL | Percent increase in AUC compared to WT ADA2 |
|---|---|---|---|
| WT ADA2 | WT ADA2 | 32,883 | — |
| PEG-WT ADA2 | PEG-WT ADA2 | 1,444,000 | 4291 |
| PEG-R23E | PEG-R20E | 1,437,333 | 4271 |
| PEG-K374D | PEG-K371D | 2,725,000 | 8187 |

TABLE 29

Comparison of half-life (t₁/₂): PEGylated ADA2 WT and HBP variants

| Test Article (Zavialov numbering) | Test article (Mature numbering) | Half life slow ($t_{1/2}$) (min) | Percent increase in $t_{1/2}$ compared to WT ADA2 |
|---|---|---|---|
| WT ADA2 | WT ADA2 | 69 | — |
| PEG-WT ADA2 | PEG-WT ADA2 | 813 | 1078 |
| PEG-R23E | PEG-R20E | 1049 | 1420 |
| PEG-K374D | PEG-K371D | 1305 | 1791 |

Example 10

Identification of ADA2 Active Site Variants with Increased Enzymatic Activity Selected candidate variants described in Table 8 above, containing an amino acid substitution in a residue that play a role in enzymatic activity, were assessed for their adenosine deaminase activity using the method described in Example 4. Table 30 lists the variants that were tested. To perform the experiments, purified WT rHuADA2 and tested variants were prepared at 5 µg/mL concentration to normalize the amount of protein in each experiment.

The results of the adenosine deaminase activity assay are set forth in Table 30 below. The percent (%) activity of each variant compared to WT-ADA2 is indicated. The results show that the activity of all tested variants containing a substitution at position 182 (position 179 by mature numbering) was substantially reduced, indicating that the glutamic acid (E) residue is important for enzymatic activity.

In contrast, other substitutions retain or exhibit increased enzymatic activity. In particular, identified variants with increased activity included: R222Q variant (R219Q by mature numbering) with 170% activity of WT, H267Q variant (H264Q by mature numbering) with 114% activity of WT, H267G (H264G by mature numbering) with 153% activity of WT, R222K (R219K by mature numbering) with 152% activity of WT, L224A (L221A by mature numbering) with 128% activity of WT, L224V (L221V by mature numbering) with 123% activity of WT, L224G (L221G by mature numbering) with 113% activity of WT, and S265N (S262N by mature numbering) with 211% activity relative of WT.

TABLE 30

Adenosine deaminase activity of variants designed for improved rHuADA2 activity

| Substitution (Zavialov numbering) | Substitution (mature numbering) | ΔA/min | mU/ml | std | % of WT activity |
|---|---|---|---|---|---|
| H267A | H264A | 30.8 | 70.9 | 8.6 | 91 |
| H267Q | H264Q | 38.8 | 89.3 | 16.2 | 114 |
| H267N | H264N | 21.9 | 50.4 | 8 | 65 |
| H267G | H264G | 51.8 | 119.1 | 10.9 | 153 |
| R222K | R219K | 51.5 | 118.5 | 6.9 | 152 |
| R222Q | R219Q | 57.8 | 132.9 | 11.6 | 170 |
| R222N | R219N | 35.4 | 81.5 | 10.7 | 104 |
| R222A | R219A | 13.6 | 31.2 | 5.7 | 40 |
| L224A | L221A | 43.5 | 100.1 | 10.9 | 128 |
| L224V | L221V | 41.8 | 96.1 | 13.3 | 123 |
| L224G | L221G | 38.3 | 88.2 | 1.6 | 113 |
| E182D | E179D | 7.8 | 18.1 | 2.1 | 23 |
| E182A | E179A | 3.7 | 8.6 | 0.8 | 11 |
| E182S | E179S | 4.1 | 9.5 | 0.1 | 12 |
| E182T | E179T | 2.7 | 6.2 | 0.2 | 8 |
| E182V | E179V | 3.5 | 8 | 0.7 | 10 |
| E182G | E179G | 3 | 6.9 | 0.7 | 9 |
| S265A | S262A | 20.5 | 47.1 | 2.5 | 60 |
| S265V | S262V | 28.8 | 66.1 | 6.8 | 85 |
| S265M | S262M | 35.5 | 81.6 | 3.4 | 105 |
| S265N | S262N | 71.7 | 164.8 | 21.4 | 211 |
| WT ADA2 | WT ADA2 | 33.9 | 78 | 1.2 | 100 |

Example 11

Generation of Combination Variants

Combinations variants were generated containing amino acid substitution(s) that increased enzymatic activity and that attenuated heparin binding. In particular, the amino acid substitution S265N and/or R222Q (S262N and/or R219Q, by mature numbering) which conferred the greatest increases in enzymatic activity as described in Example 10, were combined with one or more of amino acid substitutions K374D, K374E and/or R23E (K371D, K371E and/or R20E, respectively, by mature numbering) identified in Example 7. Variants were generated as described above in Example 1 using the QuikChange Lightning Multi Site-Directed Mutagenesis Kit. The generated combination variants are set forth in Table 31. The combination variants and corresponding single amino acid substitutions were assessed for kinetic parameters of adenosine deaminase activity and for heparin binding.

TABLE 31

Active Site and Attenuated Heparin Binding Combination Variants

| Substitution (Zavialov numbering) | Substitution (mature numbering) | SEQ ID NO: |
|---|---|---|
| S265N/K374D | S262N/K371D | 59 |
| S265N/K374E | S262N/K371E | 60 |
| S265N/R23E | S262N/R20E | 61 |
| S265N/R23E/K374D | S262N/R20E/K371D | 62 |
| S265N/R23E/K374E | S262N/R20E/K371E | 63 |
| R222Q/K374E | R219Q/K371E | 263 |
| R222Q/K374D | R219Q/K371D | 264 |
| R222Q/R23E | R219Q/R20E | 265 |
| R222Q/K374E/R23E | R219Q/K371E/R20E | 266 |
| R222Q/K374D/R23E | R219Q/K371D/R20E | 267 |
| R222Q/S265N/K374E | R219Q/S262N/K371E | 268 |
| R222Q/S265N/K374D | R219Q/S262N/K371D | 269 |
| R222Q/S265N/R23E | R219Q/S262N/R20E | 270 |
| R222Q/S265N/K374E/R23E | R219Q/S262N/K371E/R20E | 271 |
| R222Q/S265N/K374D/R23E | R219Q/S262N/K371D/R20E | 272 |
| R222Q/S265N | R219Q/S262N | 273 |

The combination variants containing the mutations S265N (S262N by mature numbering), set forth in SEQ ID NOS:59-63, and/or R222Q (R219Q by mature numbering), set forth in SEQ ID NOS:263-273, and corresponding single amino acid substitutions, were assessed for kinetic parameters of adenosine deaminase activity. The combination variants containing the mutation S265N (S262N by mature numbering), set forth in SEQ ID NOS: 59-63 and corresponding single amino acid substitutions, were assessed for heparin binding activities.

A. Kinetic Assessment of Adenosine Deaminase Activity

1. Assay Method

Adenosine deaminase activity was determined by the measurement of ammonia released from adenosine when broken down to inosine. Ammonia was measured using a commercially available Ammonia Assay kit (Cat. No. AA0100, Sigma-Aldrich, St. Louis, Mo.). The kit contains dry reagents containing α-ketoglutaric acid and NADPH, which were reconstituted with 5 mL water prior to use in the assay. Ammonia reacts with α-ketogluaric acid (KGA) and reduced nicotinamide adenine dinucleotide phosphate (NADPH) in the presence of L-glutamate dehydrogenase (GDH). The decrease in absorbance at 340 nm, due to the oxidation of NADPH, is proportional to the ammonia concentration, and hence the adenosine deaminase activity.

Kinetics parameters of rHuADA2 WT and variants were compared using this assay at different adenosine concentrations at pH 7.6 and 6.5. Adenosine concentrations ranging from 20 µM to 20 mM were used. Sub-molar concentration of adenosine stock was prepared in 1N NaOH.

For the enzymatic assays at pH 7.6, adenosine was serially diluted with 100 mM sodium acetate (NaOAc), pH 4.9. A 2× reaction mixture was prepared, containing reconstituted ammonia assay reagent (containing about 4 mM α-ketoglutarate and about 300 µM NADPH), WT rHuADA2 or variants at 1 µg/mL (17 nM) and glutamate dehydrogenase (GDH, 1:50 dilution). 85 µL of adenosine was added to 85 µL 2× mixture in duplicate in a UV-transparent half-area plate. The change in absorbance (ΔA) at 340 nm over time at room temperature was monitored.

For the enzymatic assay at pH 6.5, adenosine was serially diluted with 200 mM piperazine-N,N'-bis(2-ethanesulfonic acid) (PIPES), pH 6.5. A 2× reaction mixture in 200 mM PIPES, pH 6.5 was prepared, containing 4 mM α-ketoglutarate, 300 µM NADPH, 1 µg/mL (17 nM) rHuADA2 or variants and 50 U/mL GDH (Cat No. G2626, Sigma-Aldrich). The enzymatic reaction was initiated by adding equal volume of adenosine to the 2× mixture in a UV-transparent half-area plate as described above, and the change in absorbance (ΔA) at 340 nm over time at room temperature was monitored.

Adenosine deaminase activity in mU/mL (µM/min equivalent) was calculated using the following formula:

$$1 \text{ mU/mL} = (-\Delta A/\min \times T_v)/(S_v \times \epsilon \times 1)$$

where $T_v$=total volume (170 µL), $S_v$=sample volume (85 µL), $\epsilon$=6.22×10⁻³ µM⁻¹ cm⁻¹, 1=1 cm.

The activity data were fitted with non-linear regression of Michaelis-Menten equation using Graphpad Prism software to obtain $K_m$ and $V_{max}$. Other kinetics parameters such as $k_{cat}$ and $k_{cat}/K_m$ were also determined.

$k_{cat}$(1/s)=$V_{max}$/[E]₀

$V_{max}$ unit=µM/min

[E]₀=8.5 nM or 0.0085 µM $k_{cat}$=$V_{max}$/0.0085/60

$k_{cat}/K_m$ unit=1/Ms

2. Results

Tables 32 and 33 set forth the kinetic parameters of the rHuADA2 wild-type and variants, at pH 7.6 and pH 6.5, respectively. The $K_m$ of WT rHuADA2 was 5.25 mM at pH 7.6 and 3.66 mM at pH 6.5, and the catalytic efficiency ($k_{cat}/K_m$) of WT rHuADA2 was 9,753 at pH 7.6 and 17,060 at pH 6.5. Thus, these results show that WT rHuADA2 exhibits greater activity at pH 6.5. All tested variants exhibited improved enzyme kinetics compared to WT-ADA2. Generally, improved enzyme kinetics for the designed variants was observed more prominently at pH 6.5 than at pH 7.6.

For example, S265N (S262N by mature numbering) had significantly improved kinetics properties compared to the WT. Substitution of serine residue 265 (262 by mature numbering) to an asparagine at the active site of rHuADA2 lowered the $K_m$ value to 3.02 mM at pH 7.6 and 1.49 mM at pH 6.5, and increased the catalytic efficiency ($k_{cat}/K_m$) from 9,753 to 52,208 (1/Ms) at pH 7.6, and from 17,060 to 60,339 (1/Ms) at pH 6.5. R222Q (R219Q by mature numbering) also had significantly improved kinetics properties compared to the WT. Substitution of lysine residue 222 (219 by mature numbering) to an glutamine lowered the $K_m$ value to 1.92 mM at pH 7.6 and 0.994 mM at pH 6.5, and increased the catalytic efficiency ($k_{cat}/K_m$) from 9,753 to 60,697 (1/Ms) at pH 7.6, and from 17,060 to 83,146 (1/Ms) at pH 6.5.

The ADA2 variants K374D, K374E and R23E in Zavialov numbering (K371D, K371E and R20E, respectively, by mature numbering), identified as conferring attenuated heparin binding, also exhibited improved kinetics properties compared to WT, which was greater at pH 6.5. The combination variants containing S265N (S262N by mature numbering) further exhibited improved catalytic activity compared to WT. In particular, the combination variants S265N/K374E, S265N/R23E and S265N/R23E/K374E exhibited the greatest improvements in catalytic activity at pH 6.5 among the tested variants.

The results also show that combination variants containing R222Q (R219Q by mature numbering) have significantly improved kinetic properties compared to WT ADA2 and R222Q (R219Q by mature numbering). Among the tested ADA2 combination variants, double mutant R222Q/S265N (R219Q/S262N by mature numbering) exhibited the greatest improvement on kinetic properties, showing a 4.7-fold lower $K_m$ and 15-fold higher catalytic efficiency ($k_{cat}/K_m$) at pH 7.6, and a 5.0-fold lower $K_m$ and 8.2-fold higher catalytic efficiency ($k_{cat}/K_m$) at pH 6.5, compared to the WT ADA2. The results also show that ADA2 WT and all tested R222Q (R219Q by mature numbering) containing variants have lower $K_m$ at pH 6.5 than that at pH 7.6.

TABLE 32

Kinetic parameters of ADA2 WT and variants at pH 7.6; [E] = 8.5 nM

| Replacement (Zavialov numbering) | Replacement (mature numbering) | Vmax (μM/min) | $K_m$ (mM) | $k_{cat}$ (1/s) | $k_{cat}/K_m$ (1/Ms) |
|---|---|---|---|---|---|
| WT | WT | 26.09 | 5.25 | 51.16 | 9,753 |
| K374D | K371D | 28.25 | 4.88 | 55.39 | 11,349 |
| K374E | K371E | 35.13 | 4.77 | 68.88 | 14,438 |
| R23E | R20E | 29.08 | 5.06 | 57.02 | 11,275 |
| S265N | S262N | 80.49 | 3.02 | 157.82 | 52,208 |
| R222Q | R219Q | 59.28 | 1.92 | 116.24 | 60,697 |
| S265N/K374D | S262N/K371D | 78.29 | 2.86 | 153.51 | 53,637 |
| S265N/K374E | S262N/K371E | 87.44 | 2.54 | 171.45 | 67,554 |
| S265N/R23E | S262N/R20E | 63.13 | 2.9 | 123.78 | 42,743 |
| S265N/R23E/K374D | S262N/R20E/K371D | 72.78 | 3.13 | 142.71 | 45,564 |
| S265N/R23E/K374E | S262N/R20E/K371E | 82.38 | 2.87 | 161.53 | 56,262 |
| R222Q/K374E | R219Q/K371E | 87.27 | 1.58 | 171.12 | 108,508 |
| R222Q/K374D | R219Q/K371D | 77.01 | 1.71 | 151.00 | 88,252 |
| R222Q/R23E | R219Q/R20E | 84.71 | 1.46 | 166.10 | 114,078 |
| R222Q/K374E/R23E | R219Q/K371E/R20E | 78.42 | 1.92 | 153.76 | 80,086 |
| R222Q/K374D/R23E | R219Q/K371D/R20E | 88.43 | 1.34 | 173.39 | 129,687 |
| R222Q/S265N/K374E | R219Q/S262N/K371E | 65.43 | 1.35 | 128.29 | 95,103 |
| R222Q/S265N/K374D | R219Q/S262N/K371D | 70.96 | 1.19 | 139.14 | 117,218 |
| R222Q/S265N/R23E | R219Q/S262N/R20E | 67.24 | 1.29 | 131.84 | 102,602 |
| R222Q/S265N/K374E/R23E | R219Q/S262N/K371E/R20E | 90.91 | 1.24 | 178.25 | 143,407 |
| R222Q/S265N/K374D/R23E | R219Q/S262N/K371D/R20E | 72.58 | 1.23 | 142.31 | 115,514 |
| R222Q/S265N | R219Q/S262N | 87.79 | 1.10 | 172.14 | 157,203 |

TABLE 33

Kinetic parameters of ADA2 WT and variants at pH 6.5; [E] = 8.5 nM

| Replacement (Zavialov numbering) | Replacement (mature numbering) | Vmax (μM/min) | $K_m$ (mM) | $k_{cat}$ (1/s) | $k_{cat}/K_m$ (1/Ms) |
|---|---|---|---|---|---|
| WT | WT | 31.81 | 3.66 | 62.37 | 17,060 |
| K374D | K371D | 42.98 | 3.16 | 84.27 | 26,635 |
| K374E | K371E | 41.93 | 3.18 | 82.22 | 25,895 |
| R23E | R20E | 37.16 | 3.29 | 72.86 | 22,167 |
| S265N | S262N | 45.79 | 1.49 | 89.78 | 60,339 |
| R222Q | R219Q | 42.15 | 0.994 | 82.65 | 83,146 |
| S265N/K374D | S262N/K371D | 43.85 | 1.51 | 85.98 | 56,978 |
| S265N/K374E | S262N/K371E | 57.13 | 1.41 | 112.02 | 79,390 |
| S265N/R23E | S262N/R20E | 53.25 | 1.43 | 104.41 | 72,812 |
| S265N/R23E/K374D | S262N/R20E/K371D | 43.42 | 1.50 | 85.14 | 56,948 |
| S265N/R23E/K374E | S262N/R20E/K371E | 63.74 | 1.29 | 124.98 | 96,585 |
| R222Q/K374E | R219Q/K371E | 58.56 | 0.99 | 114.82 | 115,937 |
| R222Q/K374D | R219Q/K371D | 60.87 | 0.79 | 119.35 | 150,584 |
| R222Q/R23E | R219Q/R20E | 60.47 | 0.84 | 118.57 | 141,778 |
| R222Q/K374E/R23E | R219Q/K371E/R20E | 54.48 | 0.86 | 106.82 | 124,474 |
| R222Q/K374D/R23E | R219Q/K371D/R20E | 60.68 | 0.67 | 118.98 | 177,795 |
| R222Q/S265N/K374E | R219Q/S262N/K371E | 45.53 | 0.80 | 89.27 | 111,985 |
| R222Q/S265N/K374D | R219Q/S262N/K371D | 50.89 | 0.76 | 99.78 | 131,054 |
| R222Q/S265N/R23E | R219Q/S262N/R20E | 40.59 | 1.01 | 79.59 | 79,192 |
| R222Q/S265N/K374E/R23E | R219Q/S262N/K371E/R20E | 54.82 | 0.77 | 107.49 | 140,199 |
| R222Q/S265N/K374D/R23E | R219Q/S262N/K371D/R20E | 45.78 | 0.81 | 89.76 | 111,150 |
| R222Q/S265N | R219Q/S262N | 56.75 | 0.80 | 111.27 | 139,775 |

B. Heparin Binding of Combination Variants

Heparin binding activity of single mutants and combination variants containing S265N (S262N by mature numbering) was assessed using the ELISA-based heparin binding assay described in Example 7.A above. The results are set forth in Table 34. The results confirmed that the variants K374D, K374E and R23E exhibit attenuated binding to heparin compared to WT-ADA2. In addition, the S265N (S262N by mature numbering) variant, designed for improved enzymatic activity by modification of an active site residue, also possessed attenuated binding to heparin coated plates, indicating that modifications of the enzyme active site can impact heparin binding in an allosteric manner. Further, all of the tested combination variants showed significantly attenuated binding to heparin, illustrating that combinations of variants can be created that exhibit improved enzyme activity towards adenosine and attenuated binding to heparin.

TABLE 34

Heparin Binding ELISA assay of ADA2 WT and combination variants

| Substitution (Zavialov numbering) | Substitution (mature numbering) | Heparin Binding ELISA Average OD$_{450}$ | stdev. |
|---|---|---|---|
| K374D | K371D | 0.87 | 0.03 |
| K374E | K371E | 0.03 | 0.01 |
| R23E | R20E | 0.71 | 0.04 |
| S265N | S262N | 0.88 | 0.19 |
| S265N/K374D | S262N/K371D | 0.92 | 0.13 |
| S265N/K374E | S262N/K371E | 0.6 | 0.12 |
| S265N/R23E | S262N/R20E | 1.03 | 0.02 |
| S265N/R23E/K374D | S262N/R20E/K371D | 0.69 | 0.07 |
| S265N/R23E/K374E | S262N/R20E/K371E | 0.93 | 0.11 |
| WT ADA2 | WT ADA2 | 2.31 | 0.01 |
| WT ADA1 | WT ADA1 | −0.02 | 0 |

Example 12

Thermal Stability of rHuADA2 WT and Variants

The stability of the rHuADA2 WT and variants was measured by differential scanning fluorimetry (DSF) at increasing temperatures. DSF measures conformational stability, which correlates with thermal stability. The melting temperature (Tm) in DSF is defined as the midpoint of the protein unfolding transition.

Non-PEGylated WT rHuADA2, non-PEGylated rHuADA2 variants, and PEGylated forms of WT rHuADA2 and rHuADA2 variants were prepared at concentrations of 0.1-1 mg/mL and mixed with the ROX™ protein thermal shift dye (Applied Biosystems, Carlsbad, Calif.; Cat. No. 4461146) to a final dye concentration that corresponds to a 125-fold dilution of the stock ROX™ solution. Protein samples were then loaded into 96-well plate at a volume of 20 μL/well in triplicate. A ViiA7 RT-PCR System (Applied Biosystems, Carlsbad, Calif.) was used to measure the shift in fluorescence as the temperature of the samples were increased. The reactions were subjected to the following steps: incubation at 25° C. for 2 min; ramping of temperature from 25 to 99° C. at a rate of 0.05° C. per second; followed by a 99° C. incubation for 2 min. The wavelengths used for emission and excitation were 623 nanometers (nm) and 580 nm, respectively.

Table 35 sets forth the melting temperature (Tm) determined from the DSF analysis. The results show that the Tm of variant K374E (K371E by mature numbering) is 1.4° C. higher than WT ADA2, which indicates an improvement in thermal stability of the variant. The other tested variants show comparable or slightly lower Tm than WT ADA2. The results show that all PEGylated forms exhibited a higher Tm than the corresponding non-PEGylated from, which also indicates that PEGylation improves the thermal stability of the enzymes.

TABLE 35

Melting temperature (Tm) of ADA2 WT, variants and PEGylated forms

| Replacement (Zavialov numbering) | Replacement (mature numbering) | Tm (° C.) |
|---|---|---|
| WT ADA2 | WT ADA2 | 67.1 |
| K374D | K371D | 66.8 |
| K374E | K371E | 69.7 |
| R23E | R20E | 65.2 |
| S265N | S262N | 60.8 |

TABLE 35-continued

Melting temperature (Tm) of ADA2 WT, variants and PEGylated forms

| Replacement (Zavialov numbering) | Replacement (mature numbering) | Tm (° C.) |
|---|---|---|
| S265N/K374D | S262N/K371D | 60.8 |
| S265N/K374E | S262N/K371E | 61.3 |
| S265N/R23E | S262N/R20E | 59.6 |
| S265N/R23E/K374D | S262N/R20E/K371D | 59.8 |
| S265N/R23E/K374E | S262N/R20E/K371E | 60.4 |
| PEG-WT ADA2 | PEG-WT ADA2 | 68.81 |
| PEG-K374D | PEG-K371D | 67.81 |
| PEG-R23E | PEG-R20E | 66.4 |

Example 13 pH Optimum of rHuADA2 WT and Variants

Adenosine deaminase activity of rHuADA2 and variants at varying pH were assessed to determine the pH optimum of each. The adenosine deaminase activity was determined spectrophotometrically by direct measurement of changes in adenosine absorbance. The UV absorption spectra of adenosine (ADO) and inosine (INO) are very similar and they overlap significantly, with respective absorbance peaks at 261 nm and 249 nm. During the deamination reaction, the absorbance of ADO decreases while that of INO increases with time. Since the dynamic changes in absorbance make it difficult to monitor activity at a single wavelength, the relative ADO activity was determined as a ratio of the ADO peak to isobestic point (i.e. the wavelength where ADO and INO have the same extinction coefficient). The isobestic point, which is 253 nm, remains unchanged and is concentration independent, so that it is the reference point to correct for volume or intensity discrepancies. Therefore, changes in adenosine concentration, and hence adenosine deaminase activity, was assessed as the ratio of absorbance at 261 nm/absorbance at 253 nm ($A_{261}/A_{253}$), based on a standard curve.

A. Standard Curve

To construct the standard curve for ADO and INO, a series of solution mixtures in 0.001% Tween-20 containing different concentrations of ADO and INO were prepared. The total concentration of ADO and INO mix was 50 μM, in 1×PBS (10 mM phosphate, 137 mM NaCl, 2.7 mM KCl), pH 7.4. The samples were scanned with the wavelengths between 220 nm and 300 nm to determine the isobestic point, where all spectra cross. Table 36 sets forth the measurements for the standard curve. The $A_{261}/A_{253}$ ratio was plotted against ADO concentration and linear fitting resulted in a standard curve of $A_{261}/A_{253}=0.0249[ADO]-0.0152$ ($R^2=0.999$).

TABLE 36

Standard curve for Spectrophotometric determination of adenosine concentration

| [ADO] (μM) | $A_{261}$ | $A_{253}$ | $A_{261}/A_{253}$ |
|---|---|---|---|
| 50 | 0.669 | 0.5455 | 1.2264 |
| 49.5 | 0.6543 | 0.5366 | 1.2193 |
| 49 | 0.6493 | 0.5388 | 1.2051 |
| 48.5 | 0.6418 | 0.5378 | 1.1934 |
| 48 | 0.6352 | 0.5386 | 1.1794 |
| 47.5 | 0.6306 | 0.5406 | 1.1665 |
| 47 | 0.6244 | 0.5406 | 1.1550 |
| 46.5 | 0.6134 | 0.5363 | 1.1438 |

TABLE 36-continued

Standard curve for Spectrophotometric determination of adenosine concentration

| [ADO] (µM) | $A_{261}$ | $A_{253}$ | $A_{261}/A_{253}$ |
|---|---|---|---|
| 46 | 0.6108 | 0.5402 | 1.1307 |
| 45.5 | 0.6026 | 0.5395 | 1.1170 |
| 45 | 0.5965 | 0.5404 | 1.1038 |

B. Adenosine Deaminase Activity Spectrophotometric Assay

For performing the spectrophotometric adenosine deaminase assay of ADA2 and variants, a 2× solution containing 10 mM ADO in 100 mM potassium phosphate buffer (KPB), 0.1% Tween-20 at different pHs (i.e. 5.5, 6, 6.5, 6.75, 7, 7.25, 7.4, 7.75 and 8) were prepared. A separate 2× solution containing 2 µg/mL WT rHuADA2 or variants were prepared in the same 100 mM potassium phosphate buffer (KPB), 0.1% Tween-20 at the respective pH (i.e. 5.5, 6, 6.5, 6.75, 7, 7.25, 7.4, 7.75 and 8). An equal volume of the ADO solution and the ADA2 solution (wildtype or variants) were mixed to initiate reaction. At each time point (i.e. 1, 3, 5, 7, 9, 11, 13 and 15 min), a small aliquot (4 µl) was removed and diluted 50 times by adding to 196 µl 1×PBS, pH 7.4. The diluted samples were further diluted 2 fold (in duplicates) by adding 85 µl samples to 85 µl 1×PBS in a UV-transparent half area plate. The absorbance at 253 nm and 261 nm were measured of each diluted sample.

Adenosine concentration was determined using the $A_{261}/A_{253}$ ratio and the standard curve. Adenosine deaminase activity was measured by negative change in ADO concentration per min×100.

Table 37 sets forth the results of the adenosine deaminase activity, as measured by the spectrophotometric assay, at various pH. The results showed that the optimal pH (highest deaminase activity) for WT rHuADA2 activity is approximately 6.5. ADA2 variants K374D (K371D by mature numbering) and K374E (K371E by mature numbering) have a similar activity pH profile as WT rHuADA2.

In contrast, the ADA2 S265N variant (S262N by mature numbering) has a pH optimum at a higher pH of 7.25. Double- and triple-variants containing the S265N mutation (S262N by mature numbering) also results in a similar pH optimum at 7.25.

Example 14

In Vivo Pharmacokinetic Analysis of PEGylated rHuADA2 Combination Variants

The pharmacokinetics (PK) of the PEGylated ADA2-K374D, PEGylated ADA2-R222Q/S265N and PEGylated ADA2-R222Q/S265N/K374D variants by Zavialov numbering (K371D, R219Q/S262N and R219Q/S262N/K371D, respectively, by mature numbering) were analyzed in an immunocompetent mouse model.

A. Study Design

Twenty-seven (27) male BALB/c mice were divided into three (3) dosing groups, and were further divided into three (3) groups each for sampling of blood at different time points. Thus, the mice were randomized into nine (9) groups total. Mice were weighed prior to the start of the study, and randomized into the 9 groups based upon their body weights. In each sampling group, three groups of (3) mice were used for dosing each test article to prevent oversampling of the blood from the animals. For measurement of baseline ADA2 levels, a blood sample was obtained from 12 randomly chosen mice and plasma was prepared using the anticoagulant potassium ($K_3$) ethylene diamine tetraacetic acid ($K_3$-EDTA). All blood was collected by submandibular venipuncture.

Each mouse was injected by intravenous tail-vein injection with a 3 mg/kg dose of one of three PEGylated ADA2 variant test article as set forth in Table 38, i.e., PEG-rHuADA2-K374D (K371D by mature numbering), PEG-rHuADA2-R222Q/S265N (R219Q/S262N by mature numbering) or PEG-rHuADA2-R222Q/S265N/K374D (R219Q/S262N/K371D by mature numbering). PEGylated ADA2 variants were prepared using the PEGylation method as described in Example 8.A, with minor modifications. Briefly, all ADA2 variants at 10 mg/mL were PEGylated with linear PEG-20K (JenKem Technology, Plano, Tex.; Cat. No. M-SCM-20K) at 1:15 molar ratio and incubated first at 37° for 30 min, then at 4° C. for 16 hours. SDS-PAGE and analytical SEC results show that 100% of the ADA2 variants were PEGylated under the optimized PEGylation condition and all PEGylated ADA2 variants retained 100% enzymatic activity.

TABLE 37

Adenosine deaminase activity of ADA2 and variants at varying pH

| Replacement (Zavialov No.) | Replacement (mature No.) | Adenosine deaminase activity Δ [ADO]/min × (−100) at pH | | | | | | | | |
|---|---|---|---|---|---|---|---|---|---|---|
| | | 5.5 | 6 | 6.5 | 6.75 | 7 | 7.25 | 7.4 | 7.75 | 8 |
| WT ADA2 | WT ADA2 | 21.11 | 22.06 | 33.77 | 29.76 | 28.70 | 24.47 | 21.77 | 6.65 | 3.58 |
| K374D | K371D | 12.19 | 10.68 | 14.22 | 12.90 | 13.22 | 12.86 | 10.55 | 1.55 | 3.46 |
| K374E | K371E | 15.76 | 19.15 | 27.09 | 25.72 | 24.63 | 21.88 | 18.32 | 5.98 | 4.25 |
| R23E | R20E | 22.84 | 25.64 | 29.18 | 29.47 | 28.53 | 21.71 | 19.37 | 7.41 | 5.33 |
| S265N | S262N | 24.61 | 31.59 | 41.30 | 44.46 | 45.16 | 50.99 | 45.81 | 25.16 | 3.70 |
| S265N/K374D | S262N/K371D | 22.89 | 33.51 | 39.06 | 41.58 | 45.98 | 42.69 | 43.37 | 22.29 | 4.36 |
| S265N/K374E | S262N/K371E | 31.84 | 44.31 | 50.23 | 54.55 | 59.68 | 60.07 | 57.15 | 28.28 | 1.77 |
| S265N/R23E | S262N/R20E | 27.34 | 38.26 | 45.58 | 48.49 | 51.90 | 56.12 | 50.44 | 24.42 | 4.63 |
| S265N/R23E/K374D | S262N/R20E/K371D | 20.27 | 28.16 | 35.51 | 33.24 | 40.08 | 42.28 | 34.66 | 18.46 | 4.94 |
| S265N/R23E/K374E | S262N/R20E/K371E | 37.94 | 52.70 | 66.08 | 67.95 | 74.68 | 77.81 | 67.77 | 35.97 | 2.04 |

Approximately 200 μL of whole blood was collected at designated sampling time points from appropriate groups of mice as indicated below in Table 38 and kept on ice until plasma preparation. The initial two (2) blood samples were collected by submandibular venipuncture. The final sample was collected from a terminal bleed. Plasma was prepared by centrifuging the blood (500×g for 5 min at 4° C.), transferring the plasma to a fresh tube and immediately freezing at −80° C. until the adenosine deaminase activity assay. Adenosine deaminase activity was determined as described in Example 4.

Non-compartmental analysis (NCA) was conducted using the Phoenix WinNonlin version 6.3 (Pharsight Corp, St. Louis, Mo. 63101). The half-life, or time taken for the activity of ADA2 proteins to be reduced by half, was calculated. Also, total exposure was measured by calculating the Area Under the Concentration-time Curve (AUC). The AUC and half-life values were obtained from the unweighted average from each test article group. The following options in the Phoenix WinNonlin program were used for data analysis: (i) linear trapezoidal/linear interpolation option for AUC; (ii) best-fit slope selection option for terminal slope; and (iii) uniform weighting of the data.

TABLE 38

Pharmacokinetics Study Design for PEGylated ADA2 WT and variants

| Group # | Test Article (ZavialoNo.) | (Mature No.) | No. of Animals | Dose | Blood Collection Time points post dosing (hours) |
|---|---|---|---|---|---|
| 1 | PEG-K374D | PEG-K371D | 3 | 3 mg/kg | 0.25, 8, 48 |
| 2 | | | 3 | | 1, 4, 72 |
| 3 | | | 3 | | 2, 24, 168 |
| 4 | PEG-R222Q/ | PEG-R219Q/ | 3 | 3 mg/kg | 0.25, 8, 48 |
| 5 | S265N | S262N | 3 | | 1, 4, 72 |
| 6 | | | 3 | | 2, 24, 168 |
| 7 | PEG- | PEG- | 3 | 3 mg/kg | 0.25, 8, 48 |
| 8 | R222Q/ | R219Q/ | 3 | | 1, 4, 72 |
|   | S265N/ | S262N/ | | | |
|   | K374D | K371D | | | |
| 9 | | | 3 | | 2, 24, 168 |

B. Results

1. Pharmacokinetics of Non-PEGylated rHuADA2 WT and Variants

The pharmacokinetics (PK) properties of PEGylated ADA2 variants PEG-K374D (K371D by mature numbering), PEG-R222Q/S265N(R219Q/S262N by mature numbering) and PEG-R222Q/S265N/K374D (R219Q/S262N/K371D by mature numbering) are set forth in Tables 39 and 40. Table 39 sets forth the total exposure measured using an Area Under the Curve (AUC) calculation and Table 40 sets for the half-life ($t_{1/2}$) of the tested PEGylated rHuADA2 variants.

The results show that PEGylation substantially improves the pharmacokinetic profile of ADA2 and all tested PEGylated ADA2 variants exhibited significant higher AUC and longer half-life than the non-PEGylated WT rHuADA2 (see Example 9 and Tables 26 and 27). PEG-R222Q/S265N (R219Q/S262N by mature numbering) exhibited the largest improvement, with an AUC that is 49661% higher than the non-PEGylated WT rHuADA2, and a half-life that was 4043% longer than the non-PEGylated WT rHuADA2. The PEG-K374D (K371D by mature numbering) exhibited a greater improvement of PK properties compared to the same test article group in Example 9 and Tables 26 and 27, which can be attributed to the optimized PEGylation conditions used in preparing the test articles.

TABLE 39

Comparison of Total Exposure - Area under the Curve (AUC): PEGylated ADA2 combination variants

| Test Article (Zavialov numbering) | Test article (Mature numbering) | AUC (U * h)/mL | Percent increase in AUC compared to WT ADA2 |
|---|---|---|---|
| PEG-K374D | PEG-K371D | 4,662 | 14,177 |
| PEG-R222Q/S265N | PEG-R219Q/S262N | 16,330 | 49,661 |
| PEG-K374D/R222Q/S265N | PEG-K371D/R219Q/S262N | 9,340 | 28,404 |

TABLE 40

Comparison of half-life ($t_{1/2}$): PEGylated ADA2 variants

| Test Article (Zavialov numbering) | Test article (Mature numbering) | Half-life slow ($t_{1/2}$) (min) | Percent increase in $t_{1/2}$ compared to WT ADA2 |
|---|---|---|---|
| PEG-K374D | PEG-K371D | 2,256 | 3,269 |
| PEG-R222Q/S265N | PEG-R219Q/S262N | 2,790 | 4,043 |
| PEG-K374D/R222Q/S265N | PEG-K371D/R219Q/S262N | 2,364 | 3,426 |

Example 15

Generation of Additional Combination Variants

Additional combinations variants were generated, combining amino acid substitution(s) that increased enzymatic activity and/or amino acid substitution(s) that confer attenuated heparin binding, with other modifications, such as deletions/insertions/substitutions and amino acid replacement(s) that confer other altered activity. In particular, the amino acid substitution S265N and/or R222Q (S262N and/or R219Q, by mature numbering) which conferred the greatest increases in enzymatic activity as described in Example 10, were combined with other ADA2 modifications described in previous Examples. The amino acid replacement K374D (K371D by mature numbering) was also combined with other ADA2 modifications described in previous Examples. The combination variants are set forth in Table 41.

TABLE 41

Other Combination Variants

| Substitution (Zavialov numbering) | Substitution (mature numbering) | SEQ ID NO: |
|---|---|---|
| K374D/V102-Q147del→(GGGGS)$_1$ | K371D/V99-Q144del→(GGGGS)$_1$ | 589 |
| K374D/V102-Q147del→(GGGGS)$_2$ | K371D/V99-Q144del→(GGGGS)$_2$ | 590 |
| K374D/V102-Q147del→(GGGGS)$_3$ | K371D/V99-Q144del→(GGGGS)$_3$ | 591 |
| K374D/C108-T150del→(GGGGS)$_1$ | K371D/C105-T147del→(GGGGS)$_1$ | 592 |
| K374D/C108-T150del→(GGGGS)$_2$ | K371D/C105-T147del→(GGGGS)$_2$ | 593 |
| K374D/C108-T150del→(GGGGS)$_3$ | K371D/C105-T147del→(GGGGS)$_3$ | 594 |
| R222Q/S265N/--→N4/--→A5/--→S6 | R219Q/S262N/--→N1/--→A2/--→S3 | 596 |
| R222Q/S265N/R23N/V25S | R219Q/S262N/R20N/V22S | 597 |
| R222Q/S265N/K374N/D376S | R219Q/S262N/K371N/D373S | 598 |
| R222Q/S265N/K375N/I377S | R219Q/S262N/K372N/I374S | 599 |
| R222Q/S265N/T406N/H408S | R219Q/S262N/T403N/H405S | 600 |
| R222Q/S265N/G407N/P409S | R219Q/S262N/G404N/P406S | 601 |
| R222Q/S265N/C108-T150del→(Gly)$_{15}$ | R219Q/S262N/C105-T147del→(Gly)$_{15}$ | 602 |
| R222Q/S265N/C108-T150del→(Gly)$_{10}$ | R219Q/S262N/C105-T147del→(Gly)$_{10}$ | 603 |
| R222Q/S265N/C108-T150del→(Gly)$_7$ | R219Q/S262N/C105-T147del→(Gly)$_7$ | 604

TABLE 41-continued

Other Combination Variants

| Substitution (Zavialov numbering) | Substitution (mature numbering) | SEQ ID NO: |
|---|---|---|
| T150del→(Gly)$_{15}$ | T147del→(Gly)$_{15}$ | |
| R222Q/S265N/K374D/C108-T150del→(Gly)$_{10}$ | R219Q/S262N/K371D/C105-T147del→(Gly)$_{10}$ | 672 |
| R222Q/S265N/K374D/C108-T150del→(Gly)$_{7}$ | R219Q/S262N/K371D/C105-T147del→(Gly)$_{7}$ | 673 |
| R222Q/S265N/K374D/C108-T150del→(Gly)$_{5}$ | R219Q/S262N/K371D/C105-T147del→(Gly)$_{5}$ | 674 |
| R222Q/S265N/K374D/C108-T150del→(Gly)$_{3}$ | R219Q/S262N/K371D/C105-T147del→(Gly)$_{3}$ | 675 |
| R222Q/S265N/K14A | R219Q/S262N/K11A | 659 |
| R222Q/S265N/K14D | R219Q/S262N/K11D | 660 |
| R222Q/S265N/K14E | R219Q/S262N/K11E | 661 |
| R222Q/S265N/K16A | R219Q/S262N/K13A | 662 |
| R222Q/S265N/K16D | R219Q/S262N/K13D | 663 |
| R222Q/S265N/K16E | R219Q/S262N/K13E | 682 |
| R222Q/S265N/K374A | R219Q/S262N/K371A | 683 |
| R222Q/S265N/K375A | R219Q/S262N/K372A | 684 |
| R222Q/S265N/K375D | R219Q/S262N/K372D | 685 |
| R222Q/S265N/K375E | R219Q/S262N/K372E | 686 |
| R222Q/S265N/K455A | R219Q/S262N/K452A | 687 |
| R222Q/S265N/K455D | R219Q/S262N/K452D | 688 |
| R222Q/S265N/K455E | R219Q/S262N/K452E | 689 |
| R222Q/S265N/R23A | R219Q/S262N/R20A | 690 |
| R222Q/S265N/R23D | R219Q/S262N/R20D | 691 |
| R222Q/S265N/R369A | R219Q/S262N/R366A | 692 |
| R222Q/S265N/R369D | R219Q/S262N/R366D | 693 |
| R222Q/S265N/R369E | R219Q/S262N/R366E | 694 |
| R222Q/S265N/H267A | R219Q/S262N/H264A | 695 |
| R222Q/S265N/H267Q | R219Q/S262N/H264Q | 696 |
| R222Q/S265N/H267N | R219Q/S262N/H264N | 697 |
| R222Q/S265N/H267G | R219Q/S262N/H264G | 698 |
| R222K/S265N | R219K/S262N | 699 |
| R222N/S265N | R219N/S262N | 700 |
| R222A/S265N | R219A/S262N | 701 |
| R222Q/S265N/L224A | R219Q/S262N/L221A | 702 |
| R222Q/S265N/L224V | R219Q/S262N/L221V | 703 |
| R222Q/S265N/L224G | R219Q/S262N/L221G | 704 |
| R222Q/S265N/E182D | R219Q/S262N/E179D | 705 |
| R222Q/S265N/E182A | R219Q/S262N/E179A | 706 |
| R222Q/S265N/E182S | R219Q/S262N/E179S | 707 |
| R222Q/S265N/E182T | R219Q/S262N/E179T | 708 |
| R222Q/S265N/E182V | R219Q/S262N/E179V | 709 |
| R222Q/S265N/E182G | R219Q/S262N/E179G | 710 |
| R222Q/S265A | R219Q/S262A | 711 |
| R222Q/S265V | R219Q/S262V | 712 |
| R222Q/S265M | R219Q/S262M | 713 |
| R222Q/S265N/K14A/R23A | R219Q/S262N/K11A/R20A | 714 |
| R222Q/S265N/K14A/R23A/K374A | R219Q/S262N/K11A/R20A/K371A | 715 |
| R222Q/S265N/R23A/K374A | R219Q/S262N/R20A/K371A | 716 |
| R222Q/S265N/K14A/K374A | R219Q/S262N/K11A/K371A | 717 |
| R222Q/S265N/K29A | R219Q/S262N/K26A | 718 |
| R222Q/S265N/K29D | R219Q/S262N/K26D | 719 |
| R222Q/S265N/K29E | R219Q/S262N/K26E | 720 |
| R222Q/S265N/R220A | R219Q/S262N/R217A | 721 |
| R222Q/S265N/R220D | R219Q/S262N/R217D | 722 |
| R222Q/S265N/R220E | R219Q/S262N/R217E | 723 |
| R222Q/S265N/K261A | R219Q/S262N/K258A | 724 |
| R222Q/S265N/K261D | R219Q/S262N/K258D | 725 |
| R222Q/S265N/K261E | R219Q/S262N/K258E | 726 |
| R222Q/S265N/R280A | R219Q/S262N/R277A | 727 |
| R222Q/S265N/R280D | R219Q/S262N/R277D | 728 |
| R222Q/S265N/R280E | R219Q/S262N/R277E | 729 |
| R222Q/S265N/R286A | R219Q/S262N/R283A | 730 |
| R222Q/S265N/R286D | R219Q/S262N/R283D | 731 |
| R222Q/S265N/R286E | R219Q/S262N/R283E | 732 |
| R222Q/S265N/K312A | R219Q/S262N/K309A | 733 |
| R222Q/S265N/K312D | R219Q/S262N/K309D | 734 |
| R222Q/S265N/K312E | R219Q/S262N/K309E | 735 |
| R222Q/S265N/K320A | R219Q/S262N/K317A | 736 |
| R222Q/S265N/K320D | R219Q/S262N/K317D | 737 |
| R222Q/S265N/K320E | R219Q/S262N/K317E | 738 |
| R222Q/S265N/K324A | R219Q/S262N/K321A | 739 |
| R222Q/S265N/K324D | R219Q/S262N/K321D | 740 |
| R222Q/S265N/K324E | R219Q/S262N/K321E | 741 |

TABLE 41-continued

| Other Combination Variants | | |
|---|---|---|
| Substitution (Zavialov numbering) | Substitution (mature numbering) | SEQ ID NO: |
| R222Q/S265N/R355A | R219Q/S262N/R352A | 742 |
| R222Q/S265N/R355D | R219Q/S262N/R352D | 743 |
| R222Q/S265N/R355E | R219Q/S262N/R352E | 744 |
| R222Q/S265N/R444A | R219Q/S262N/R441A | 745 |
| R222Q/S265N/R444D | R219Q/S262N/R441D | 746 |
| R222Q/S265N/R444E | R219Q/S262N/R441E | 747 |
| R222Q/S265N/K447A | R219Q/S262N/K444A | 748 |
| R222Q/S265N/K447D | R219Q/S262N/K444D | 749 |
| R222Q/S265N/K447E | R219Q/S262N/K444E | 750 |
| R222Q/S265N/K464A | R219Q/S262N/K461A | 751 |
| R222Q/S265N/K464D | R219Q/S262N/K461D | 752 |
| R222Q/S265N/K464E | R219Q/S262N/K461E | 753 |
| R222Q/S265N/K472A | R219Q/S262N/K469A | 754 |
| R222Q/S265N/K472D | R219Q/S262N/K469D | 755 |
| R222Q/S265N/K472E | R219Q/S262N/K469E | 756 |
| R222Q/S265N/K473A | R219Q/S262N/K470A | 757 |
| R222Q/S265N/K473D | R219Q/S262N/K470D | 758 |
| R222Q/S265N/K473E | R219Q/S262N/K470E | 759 |
| R222Q/S265N/D89A | R219Q/S262N/D86A | 760 |
| R222Q/S265N/D89C | R219Q/S262N/D86C | 761 |
| R222Q/S265N/D89E | R219Q/S262N/D86E | 762 |
| R222Q/S265N/D89F | R219Q/S262N/D86F | 763 |
| R222Q/S265N/D89G | R219Q/S262N/D86G | 764 |
| R222Q/S265N/D89H | R219Q/S262N/D86H | 765 |
| R222Q/S265N/D89I | R219Q/S262N/D86I | 766 |
| R222Q/S265N/D89K | R219Q/S262N/D86K | 767 |
| R222Q/S265N/D89L | R219Q/S262N/D86L | 768 |
| R222Q/S265N/D89M | R219Q/S262N/D86M | 769 |
| R222Q/S265N/D89N | R219Q/S262N/D86N | 770 |
| R222Q/S265N/D89P | R219Q/S262N/D86P | 771 |
| R222Q/S265N/D89Q | R219Q/S262N/D86Q | 772 |
| R222Q/S265N/D89R | R219Q/S262N/D86R | 773 |
| R222Q/S265N/D89S | R219Q/S262N/D86S | 774 |
| R222Q/S265N/D89T | R219Q/S262N/D86T | 775 |
| R222Q/S265N/D89V | R219Q/S262N/D86V | 776 |
| R222Q/S265N/D89W | R219Q/S262N/D86W | 777 |
| R222Q/S265N/D89Y | R219Q/S262N/D86Y | 778 |
| R222Q/S265N/E182C | R219Q/S262N/E179C | 779 |
| R222Q/S265N/E182F | R219Q/S262N/E179F | 780 |
| R222Q/S265N/E182H | R219Q/S262N/E179H | 781 |
| R222Q/S265N/E182I | R219Q/S262N/E179I | 782 |
| R222Q/S265N/E182K | R219Q/S262N/E179K | 783 |
| R222Q/S265N/E182L | R219Q/S262N/E179L | 784 |
| R222Q/S265N/E182M | R219Q/S262N/E179M | 785 |
| R222Q/S265N/E182N | R219Q/S262N/E179N | 786 |
| R222Q/S265N/E182P | R219Q/S262N/E179P | 787 |
| R222Q/S265N/E182Q | R219Q/S262N/E179Q | 788 |
| R222Q/S265N/E182R | R219Q/S262N/E179R | 789 |
| R222Q/S265N/E182W | R219Q/S262N/E179W | 790 |
| R222Q/S265N/E182Y | R219Q/S262N/E179Y | 791 |
| R222C/S265N | R219C/S262N | 792 |
| R222D/S265N | R219D/S262N | 793 |
| R222E/S265N | R219E/S262N | 794 |
| R222F/S265N | R219F/S262N | 795 |
| R222G/S265N | R219G/S262N | 796 |
| R222H/S265N | R219H/S262N | 797 |
| R222I/S265N | R219I/S262N | 798 |
| R222L/S265N | R219L/S262N | 799 |
| R222M/S265N | R219M/S262N | 800 |
| R222P/S265N | R219P/S262N | 801 |
| R222S/S265N | R219S/S262N | 802 |
| R222T/S265N | R219T/S262N | 803 |
| R222V/S265N | R219V/S262N | 804 |
| R222W/S265N | R219W/S262N | 805 |
| R222Y/S265N | R219Y/S262N | 806 |
| R222Q/S265N/L224C | R219Q/S262N/L221C | 807 |
| R222Q/S265N/L224D | R219Q/S262N/L221D | 808 |
| R222Q/S265N/L224E | R219Q/S262N/L221E | 809 |
| R222Q/S265N/L224F | R219Q/S262N/L221F | 810 |
| R222Q/S265N/L224H | R219Q/S262N/L221H | 811 |
| R222Q/S265N/L224I | R219Q/S262N/L221I | 812 |
| R222Q/S265N/L224K | R219Q/S262N/L221K | 813 |
| R222Q/S265N/L224M | R219Q/S262N/L221M | 814 |
| R222Q/S265N/L224N | R219Q/S262N/L221N | 815 |

TABLE 41-continued

| Other Combination Variants | | |
|---|---|---|
| Substitution (Zavialov numbering) | Substitution (mature numbering) | SEQ ID NO: |
| R222Q/S265N/L224P | R219Q/S262N/L221P | 816 |
| R222Q/S265N/L224Q | R219Q/S262N/L221Q | 817 |
| R222Q/S265N/L224R | R219Q/S262N/L221R | 818 |
| R222Q/S265N/L224S | R219Q/S262N/L221S | 819 |
| R222Q/S265N/L224T | R219Q/S262N/L221T | 820 |
| R222Q/S265N/L224W | R219Q/S262N/L221W | 821 |
| R222Q/S265N/L224Y | R219Q/S262N/L221Y | 822 |
| R222Q/S265C | R219Q/S262C | 823 |
| R222Q/S265D | R219Q/S262D | 824 |
| R222Q/S265E | R219Q/S262E | 825 |
| R222Q/S265F | R219Q/S262F | 826 |
| R222Q/S265G | R219Q/S262G | 827 |
| R222Q/S265H | R219Q/S262H | 828 |
| R222Q/S265I | R219Q/S262I | 829 |
| R222Q/S265K | R219Q/S262K | 830 |
| R222Q/S265L | R219Q/S262L | 831 |
| R222Q/S265P | R219Q/S262P | 832 |
| R222Q/S265Q | R219Q/S262Q | 833 |
| R222Q/S265R | R219Q/S262R | 834 |
| R222Q/S265T | R219Q/S262T | 835 |
| R222Q/S265W | R219Q/S262W | 836 |
| R222Q/S265Y | R219Q/S262Y | 837 |
| R222Q/S265N/H267C | R219Q/S262N/H264C | 838 |
| R222Q/S265N/H267D | R219Q/S262N/H264D | 839 |
| R222Q/S265N/H267E | R219Q/S262N/H264E | 840 |
| R222Q/S265N/H267F | R219Q/S262N/H264F | 841 |
| R222Q/S265N/H267I | R219Q/S262N/H264I | 842 |
| R222Q/S265N/H267K | R219Q/S262N/H264K | 843 |
| R222Q/S265N/H267L | R219Q/S262N/H264L | 844 |
| R222Q/S265N/H267M | R219Q/S262N/H264M | 845 |
| R222Q/S265N/H267P | R219Q/S262N/H264P | 846 |
| R222Q/S265N/H267R | R219Q/S262N/H264R | 847 |
| R222Q/S265N/H267S | R219Q/S262N/H264S | 848 |
| R222Q/S265N/H267T | R219Q/S262N/H264T | 849 |
| R222Q/S265N/H267V | R219Q/S262N/H264V | 850 |
| R222Q/S265N/H267W | R219Q/S262N/H264W | 851 |
| R222Q/S265N/H267Y | R219Q/S262N/H264Y | 852 |
| R222Q/S265N/S269A | R219Q/S262N/S266A | 853 |
| R222Q/S265N/S269C | R219Q/S262N/S266C | 854 |
| R222Q/S265N/S269D | R219Q/S262N/S266D | 855 |
| R222Q/S265N/S269E | R219Q/S262N/S266E | 856 |
| R222Q/S265N/S269F | R219Q/S262N/S266F | 857 |
| R222Q/S265N/S269G | R219Q/S262N/S266G | 858 |
| R222Q/S265N/S269H | R219Q/S262N/S266H | 859 |
| R222Q/S265N/S269I | R219Q/S262N/S266I | 860 |
| R222Q/S265N/S269K | R219Q/S262N/S266K | 861 |
| R222Q/S265N/S269L | R219Q/S262N/S266L | 862 |
| R222Q/S265N/S269M | R219Q/S262N/S266M | 863 |
| R222Q/S265N/S269N | R219Q/S262N/S266N | 864 |
| R222Q/S265N/S269P | R219Q/S262N/S266P | 865 |
| R222Q/S265N/S269Q | R219Q/S262N/S266Q | 866 |
| R222Q/S265N/S269R | R219Q/S262N/S266R | 867 |
| R222Q/S265N/S269T | R219Q/S262N/S266T | 868 |
| R222Q/S265N/S269V | R219Q/S262N/S266V | 869 |
| R222Q/S265N/S269W | R219Q/S262N/S266W | 870 |
| R222Q/S265N/S269Y | R219Q/S262N/S266Y | 871 |
| R222Q/S265N/K270A | R219Q/S262N/K267A | 872 |
| R222Q/S265N/K270C | R219Q/S262N/K267C | 873 |
| R222Q/S265N/K270D | R219Q/S262N/K267D | 874 |
| R222Q/S265N/K270E | R219Q/S262N/K267E | 875 |
| R222Q/S265N/K270F | R219Q/S262N/K267F | 876 |
| R222Q/S265N/K270G | R219Q/S262N/K267G | 877 |
| R222Q/S265N/K270H | R219Q/S262N/K267H | 878 |
| R222Q/S265N/K270I | R219Q/S262N/K267I | 879 |
| R222Q/S265N/K270L | R219Q/S262N/K267L | 880 |
| R222Q/S265N/K270M | R219Q/S262N/K267M | 881 |
| R222Q/S265N/K270N | R219Q/S262N/K267N | 882 |
| R222Q/S265N/K270P | R219Q/S262N/K267P | 883 |
| R222Q/S265N/K270Q | R219Q/S262N/K267Q | 884 |
| R222Q/S265N/K270R | R219Q/S262N/K267R | 885 |
| R222Q/S265N/K270S | R219Q/S262N/K267S | 886 |
| R222Q/S265N/K270T | R219Q/S262N/K267T | 887 |
| R222Q/S265N/K270V | R219Q/S262N/K267V | 888 |
| R222Q/S265N/K270W | R219Q/S262N/K267W | 889 |

TABLE 41-continued

Other Combination Variants

| Substitution (Zavialov numbering) | Substitution (mature numbering) | SEQ ID NO: |
|---|---|---|
| R222Q/S265N/K270Y | R219Q/S262N/K267Y | 890 |
| R222Q/S265N/V299A | R219Q/S262N/V296A | 891 |
| R222Q/S265N/V299C | R219Q/S262N/V296C | 892 |
| R222Q/S265N/V299D | R219Q/S262N/V296D | 893 |
| R222Q/S265N/V299E | R219Q/S262N/V296E | 894 |
| R222Q/S265N/V299F | R219Q/S262N/V296F | 895 |
| R222Q/S265N/V299G | R219Q/S262N/V296G | 896 |
| R222Q/S265N/V299H | R219Q/S262N/V296H | 897 |
| R222Q/S265N/V299I | R219Q/S262N/V296I | 898 |
| R222Q/S265N/V299K | R219Q/S262N/V296K | 899 |
| R222Q/S265N/V299L | R219Q/S262N/V296L | 900 |
| R222Q/S265N/V299M | R219Q/S262N/V296M | 901 |
| R222Q/S265N/V299N | R219Q/S262N/V296N | 902 |
| R222Q/S265N/V299P | R219Q/S262N/V296P | 903 |
| R222Q/S265N/V299Q | R219Q/S262N/V296Q | 904 |
| R222Q/S265N/V299R | R219Q/S262N/V296R | 905 |
| R222Q/S265N/V299S | R219Q/S262N/V296S | 906 |
| R222Q/S265N/V299T | R219Q/S262N/V296T | 907 |
| R222Q/S265N/V299W | R219Q/S262N/V296W | 908 |
| R222Q/S265N/V299Y | R219Q/S262N/V296Y | 909 |
| R222Q/K14A/R23A | R219Q/K11A/R20A | 910 |
| R222Q/K14A/R23A/K374A | R219Q/K11A/R20A/K371A | 911 |
| R222Q/R23A/K374A | R219Q/R20A/K371A | 912 |
| R222Q/K14A/K374A | R219Q/K11A/K371A | 913 |
| S265N/K14A/R23A | S262N/K11A/R20A | 914 |
| S265N/K14A/R23A/K374A | S262N/K11A/R20A/K371A | 915 |
| S265N/R23A/K374A | S262N/R20A/K371A | 916 |
| S265N/K14A/K374A | S262N/K11A/K371A | 917 |

Example 16

Kinetic Assessment of Adenosine Deaminase Activity of rHuADA2 PRB Domain Deletion Combination Variants Combination variants containing the K374D mutation (K371D by mature numbering) and PRB deletions replaced with (GGGGS)$_n$ linker, set forth in SEQ ID NOS:588-593, were assessed for kinetic parameters of adenosine deaminase activity, using the assay method described in Example 11.A above. The first set of variants contain a deletion of residues V102-Q147 (V99-Q144, by mature numbering), replaced with (GGGGS)$_n$ linker of various length (e.g., n=1, 2 or 3; set forth in SEQ ID NOS: 588-590), and the second set of variants contain a deletion of residues C108-T150 (C105-T147, by mature numbering), replaced with (GGGGS)$_n$ linker of various length (e.g., n=1, 2 or 3; set forth in SEQ ID NOS: 591-593. Kinetic parameters were tested at pH 7.6, and the results are set forth in Table 42.

The results indicate that all tested ADA2 PRB domain deletion mutants remain enzymatic activity, and generally exhibit approximately 5 to 7-fold lower $K_m$ and 8 to 11-fold higher catalytic efficiency ($k_{cat}/K_m$) at pH 7.6, compared to the WT ADA2.

TABLE 42

Kinetic parameters of ADA2 WT and variants at pH 7.6; [E] = 8.5 nM

| Replacement (Zavialov numbering) | Replacement (mature numbering) | Vmax (μM/min) | $K_m$ (mM) | $k_{cat}$ (1/s) | $k_{cat}/K_m$ (1/Ms) |
|---|---|---|---|---|---|
| K374D/V102-Q147del→(GGGGS)$_1$ | K371D/V99-Q144del→(GGGGS)$_1$ | 43.46 | 0.89 | 85.22 | 95,748 |
| K374D/V102-Q147del→(GGGGS)$_2$ | K371D/V99-Q144del→(GGGGS)$_2$ | 44.52 | 0.87 | 87.29 | 100,338 |
| K374D/V102-Q147del→(GGGGS)$_3$ | K371D/V99-Q144del→(GGGGS)$_3$ | 43.01 | 0.82 | 84.33 | 102,846 |
| K374D/C108-T150del→(GGGGS)$_1$ | K371D/C105-T147del→(GGGGS)$_1$ | 43.1 | 0.91 | 84.51 | 92,532 |
| K374D/C108-T150del→(GGGGS)$_2$ | K371D/C105-T147del→(GGGGS)$_2$ | 36.92 | 0.85 | 72.39 | 85,167 |
| K374D/C108-T150del→(GGGGS)$_3$ | K371D/C105-T147del→(GGGGS)$_3$ | 38.12 | 0.77 | 74.75 | 97,223 |

Example 17

Tumor Growth Inhibition (TGI) Assessment of PEGylated rHuADA2-K374D Using the CT26 Syngeneic Tumor Model The murine CT26 syngeneic tumor model was used to assess the antitumor activity of ADA2.

A. Syngeneic Tumor Model and Treatment

Forty-four (44) male BALB/c mice were inoculated subcutaneously with $5 \times 10^6$ murine colon cancer tumor cells (CT26, ATCC CRL-2638) in 0.1 mL injection volume per animal. Tumor volume was determined using digital calipers by caliper measurement of the length (L) and width (W) of the solid tumor masses. Tumor volume (TV) was calculated as: $(L \times W^2)/2$. Tumors were allowed to grow and tumor bearing mice were staged until when the tumors were palpable and measured to be about 50-100 mm³.

PEGylated rHuADA2-K374D (K371D by mature numbering) was prepared as described in Example 8.A, with minor modifications to generate a preparation in which approximately 100% of the molecules were PEGylated as assessed by SDS-PAGE. Briefly, a preparation of rHuADA2-K374D (K371D by mature numbering) at 10 mg/mL was mixed with linear PEG-20K (JenKem Technology, Plano, Tex.; Cat. No. M-SCM-20K) at 1:15 molar ratio and incubated first at 4° C. for 16 hours, and then at 30° C. for 60 min.

For treatment, animals were randomized into four groups (n=8/group). CT26 tumor bearing mice were then injected intravenously (IV) every other day, at 3 mg/kg body weight, 10 mg/kg body weight or 30 mg/kg body weight doses of PEG-K374D (PEG-K371D by mature numbering) or vehicle control (buffer only) every other day. Tumor volume was measured at day 0 and 8 using caliper measurement as described above. Percent Tumor Growth Inhibition (TGI) for each respective tumor model was calculated using the following equation:

$$\% \text{ TGI} = [1 - (T_n - T_0) \div (C_n - C_0)] \times 100\%$$

where "$T_n$" is the average tumor volume for the treatment group at day "n" after the final dose of PEG-K374D or control; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment. One mouse from the vehicle group was excluded due to significant tumor growth inhibition.

B. Results

Table 43 sets forth the results of the average tumor volume and tumor growth inhibition at day 8 in the mice administered with PEG-K374D compared to the vehicle injected control. At day 8, the average tumor volume for the vehicle control group was 446.67 mm³ (n=7). For the group injected with 3 mg/kg of PEG-K374D, the average tumor volume was 257.72 mm³, indicating a tumor growth inhibition (TGI) of 50% (n=8; p-value=0.037). For the group injected with 10 mg/kg of PEG-K374D, the average tumor volume was 207.84 mm³, indicating a TGI of 63% (n=8; p-value=0.0056). For the group injected with 30 mg/kg of PEG-K374D, the average tumor volume was 187.32 mm³, indicating a TGI of 68% (n=8; p-value=0.0085). The results show that administration of PEG-K374D results in significant tumor growth inhibition.

TABLE 43

Tumor volume and tumor growth inhibition (TGI) in mice administered with PEG-K374D

| Dose | No. of Mice per group | Average Tumor Volume (mm³) | Tumor Growth Inhibition | p value (t-Test) compared to vehicle |
|---|---|---|---|---|
| Vehicle | 7 | 446.67 | 0% | |
| 3 mg/kg | 8 | 257.72 | 50% | 0.037 |
| 10 mg/kg | 8 | 207.84 | 63% | 0.0056 |
| 30 mg/kg | 8 | 187.32 | 68% | 0.0085 |

Example 18

Tumor Growth Inhibition (TGI) Assessment of Combination Therapy with PEGYLATED rHuADA2, Anti-PD-1 and Anti-CTLA4

The murine CT26 syngeneic tumor model was used to compare the antitumor activity of combination therapy using PEGylated ADA2 with checkpoint inhibitors anti-PD-1 and anti-CTLA4 antibodies. CT26 syngeneic tumors were produced by injecting $2 \times 10^5$ CT26 cells in 0.05 mL injection volume per animal into the right peritibial muscle of male Balb/C mice. Tumor bearing mice were staged into treatment groups when the average tumor size reached 150 mm³.

For treatment, animals were randomized into 8 groups (n=8/group) as follows: 1) saline vehicle control, 2) PEG-ADA2-K374D, 3) α-CTLA4 antibody (Clone 9D9, Cat. No. BE0164; BioXCell, West Lebanon, N.H., 4) α-PD-1 antibody (Clone RMP1-14, Cat. No. BE0146; BioXCell, West Lebanon, N.H.), 5) PEG-ADA2-K374D+α-CTLA4; 6) PEG-K374D+α-PD-1; 7) α-CTLA4+α-PD-1, or 8) Triple combo (PEG-ADA2-K374D+α-CTLA4+α-PD-1). PEG-ADA2-K374D was dosed intravenously 3× weekly at 10 mg/kg, α-CTLA4 was dosed intraperiotoneally biweekly at 4 mg/kg, and α-PD-1 was dosed intraperitoneally biweekly at 4 mg/kg. The sequence of dosing in the combination groups was as follows: PEG-ADA2-K374D followed by α-CTLA4 followed by α-PD-1.

Tumor volume was assessed twice weekly via ultrasound imaging using the Vevo2100 (Visual Sonics, Toronto, Canada) to determine tumor growth inhibition (TGI). Animals were anesthetized using light isoflurane anesthesia while the tumor volumes were measured. For tumor measurement, the region of interest was covered in ultrasound gel (Parker Laboratories, Fairfield, N.J.), and the RMV-716 (focal depth=17.5 mm) scan head was positioned directly over the region of interest. While in 2D-Mode, the approximate center of the tumor was located, and subsequently an image (~150-200 frames) was captured using 3D-mode. Approximately 15-30 frames out of 150-200 frames were analyzed and a tumor volume calculated and expressed in mm³. Tumor growth Inhibition (TGI) was calculated as described above.

The results are presented in Table 44. Table 44 depicts the average tumor volume per group, on study day 10 (SD10), 48 hours after PEG-ADA2-K374D and 72 hours after α-CTLA4 and α-PD-1, and the range of tumor volume of all animals in the group. The TGI compared to vehicle control also is depicted. The results show that PEG-ADA2-K374D, α-CTLA4 and α-PD-1 each individually exhibited tumor growth inhibition activity, with α-CTLA4 exhibiting greater tumor growth reduction than the other single treatments. The results show a slight synergistic effect of the combination therapy of PEG-ADA2-K374D with either α-CTLA4 or α-PD-1. A further increase in tumor growth inhibition was observed in the triple combination therapy. In contrast, the combination therapy of α-CTLA4 and α-PD-1 only slightly increased tumor growth inhibition as compared to treatment with α-CTLA4.

TABLE 44

Tumor Growth Inhibition of Combination Therapy

| Treatment | Average Group Tumor Volume, SD10 | Volume Range | TGI |
|---|---|---|---|
| Vehicle | 1567.53 | 1389-1890 | — |
| PEG-ADA2-K374D | 1499.11 | 1213-1594 | 5% |
| α-CTLA4 | 1050.78 | 860-1232 | 37% |
| α-PD-1 | 1359.2 | 1131-1616 | 15% |
| PEG-ADA2-K374D + α-CTLA4 | 965.21 | 731-1207 | 43% |
| PEG-ADA2-K374D + α-PD-1 | 1244.43 | 687-1539 | 23% |
| α-CTLA4 + α-PD-1 | 993.97 | 763-1252 | 41% |
| Triple Combo | 835.77 | 687-989 | 52% |

Example 19

PEG-ADA2 Distribution in CT26 Peritibial Tumors or Normal Organs

To assess the distribution and elimination of administered PEG-ADA2-K374D in the tumor microenvironment or in normal organs, immunofluorescence was used to assess the presence of PEG-ADA2-K374D administered to mice. PEG-ADA2-K374D was labeled at room temperature for 60 minutes with DyLight755 Sulfydryl-Reactive Dye (DL755), a near-IR fluor, using the DyLight 755 Antibody Labeling Kit (Thermo Scientific, Rockford, Ill.). Alexa Fluor 750 (AF 750) labeled bovine serum albumin (BSA, 1 mg/mL) was purchased from (Life Technology, Carlsbad, Calif.).

A. Distribution in CT26 Peritibial Tumors

CT26 syngeneic tumors were produced by injecting $2 \times 10^5$ cells in 0.05 mL injection volume per animal into the right peritibial muscle of male Balb/C mice. When average tumor size reached 600 mm³, tumor-bearing mice were staged into 2 groups (n=4/group) to receive either PEG-ADA2-K374D$^{DL755}$ at 0.5 mg/kg or BSA$^{AF750}$ at 0.5 mg/kg intravenously. The distribution of DL755 labeled PEG-ADA2-K374D (PEG-ADA2-K374D$^{DL755}$) and AF 750 labeled BSA (BSA$^{AF750}$) in mouse tumors was assessed using the IVIS Caliper fluorescent imaging system with an excitation wavelength of 745 nm and an emission wavelength of 800 nm (Caliper Life Sciences, Alameda, Calif.) and signal intensity was measured with LivingImage software. Images were captured before administration of labeled proteins and at 10 minute, 2, 6 hours and daily after administration of labeled proteins.

The results are set forth in Table 45. The images showed a strong fluorescent intensity at the tumor site in all treatment groups. Fluorescent intensity of images demonstrated PEG-ADA2-K374D$^{DL755}$ rapidly accessed to CT26 tumor and reached the plateau at 48 hours. Only 30% of PEG-ADA2-K374D$^{DL755}$ was eliminated from tumors on day 6 post PEG-ADA2-K374D$^{DL755}$ injection. In contrast, less control agent BSA$^{AF750}$ accessed to the tumors, and the fluorescent intensity was reduced quickly. Nearly 100% of BSA$^{AF750}$ was eliminated from the tumors on day 6. Thus, the results demonstrate that PEG-ADA2-K374D$^{DL755}$ has a high affinity to CT26 tumors.

TABLE 45

Tumor Distribution

| Hour | BSA$^{AF750}$ (Fluorescent intensity) | | PEG-ADA2-K374D$^{DL755}$ (Fluorescent intensity) | |
|---|---|---|---|---|
| −1 | 7.86E+08 | ±6.92E7 | 7.80E+08 | ±5.67E7 |
| 0.2 | 2.95E+09 | ±9.69E7 | 4.52E+09 | ±5.72E8 |
| 2 | 3.92E+09 | ±2.93E8 | 4.64E+09 | ±6.06E8 |
| 6 | 4.64E+09 | ±7.81E8 | 6.54E+09 | ±6.44E8 |
| 24 | 3.18E+09 | ±4.88E8 | 9.48E+09 | ±1.30E9 |
| 48 | 1.94E+09 | ±7.70E7 | 1.12E+10 | ±8.26E8 |
| 72 | 1.30E+09 | ±1.40E8 | 8.95E+09 | ±7.40E8 |
| 96 | 9.86E+08 | ±2.98E7 | 1.07E+10 | ±8.26E8 |
| 144 | 7.78E+08 | ±3.45E7 | 4.83E+09 | ±5.80E8 |
| 168 | 6.39E+08 | ±7.03E7 | 3.64E+09 | ±3.10E8 |
| 196 | 6.59E+08 | ±3.42E7 | 2.68E+09 | ±4.09E8 |

B. Comparison of Distribution in CT26-Tumor Bearing Mice or Balb/C Naïve Mice

To compare the distribution in naïve mice, CT26-tumor bearing mice were generated as described above, and were intravenously administered PEG-ADA2-K374D$^{DL755}$ at 0.5 mg/kg (n=3). Separately, naïve Balb/c mice also were intravenously administered PEG-ADA2-K374D$^{DL755}$ at 0.5 mg/kg (n=4). The mice were sacrificed and transcardically perfused with heparin normal saline 24 hours post PEG-ADA2-K374D$^{DL755}$ injection. Tumors from tumor-bearing mice and organs from naïve mice were collected and imaged with IVIS image system, and DL755 signal intensity was measured with LivingImage software as described above. Signal intensity was normalized by tissue organ weight.

The results are set forth in Table 46. Signal intensity or each organ was compared to the signal intensity of the tumor, and set forth as a ratio (tumor/organ). The results showed that compared to the other organs, the highest signal intensity was observed in the tumor. The liver and spleen did show high fluorescent intensity, which was 1.5-fold and 2.1-fold less, respectively, than in the tumor. Other organs, such as the brain and heart, showed low signal intensity with 29-fold and 11-fold, respectively, less signal intensity than the tumor. Thus, the results show that PEG-ADA2-K374D$^{DL755}$ has a lower affinity to normal organs.

TABLE 46

Distribution in Normal Organs vs. Tumors

| Organ | PEG-ADA2-K374D, 24 hr (Fluorescent intensity/ Tissue Weight) - Baseline | | Signal Intensity (Tumor vs Organ) |
|---|---|---|---|
| Lung | 1.22E+06 | ±1.11E6 | 5.1 |
| Heart | 5.55E+05 | ±1.88E5 | 11.2 |
| Liver | 4.02E+06 | ±5.17E5 | 1.5 |
| Spleen | 2.98E+06 | ±7.44E5 | 2.1 |
| Kidney | 8.61E+05 | ±8.23E5 | 7.2 |
| Colon | 9.13E+05 | ±3.01E5 | 6.8 |
| Brain | 2.11E+05 | ±1.86E5 | 29.5 |
| Bone | 1.82E+06 | ±7.04E5 | 3.4 |
| Tumor | 6.22E+06 | ±2.29E6 | — |

Example 20

Tumor Growth Inhibition (TGI) and Survival Assessment of PEGylated rHuADA2-R222Q/S265N Using the MH194+PSC4 Syngeneic Tumor Model The murine MH194+PSC4 syngeneic tumor model was used to assess the antitumor efficacy of PEGylated a recombinant adenosine deaminase 2 (ADA2), PEGylated rHuADA2-R222Q/S265N (PEG-R222Q/S265N; PEG-R219Q/S262N by mature numbering). The MH194 mouse pancreatic carcinoma cells are derived from the KrasLSL.G12D/+p53R172H/+PdxCretg/+ genetically engineered mouse model The PSC4 cells are isolated and immortalized pancreatic stellate cells.

A. Syngeneic Tumor Model

The murine MH194+PSC4 syngeneic tumor model was used to assess the antitumor efficacy of PEGylated a recombinant adenosine deaminase 2 (ADA2), PEGylated rHuADA2-R222Q/S265N (PEG-R222Q/S265N; PEG-R219Q/S262N by mature numbering).

The PSC4 cells are isolated and immortalized pancreatic stellate cells. To generate the PSC4 cells, pancreas from C57BL/6 mice were minced with razor blades and placed in 2 mL of a digestion buffer containing 0.05% collagenase P, 0.1% DNAse, and 0.02% Pronase in Gey's balanced salt solution (GBSS). Following two 15 min digestion incubations at 37° C. with thorough mixing after each incubation, the resulting cell suspension was filtered through a 100 µm nylon mesh, washed twice in GBSS with 0.3% bovine serum albumin (BSA), and resuspended in 10 mL GBSS/BSA. Eight mL of Histodenz (Sigma, Cat. No. D2158) was added to the cell suspension, and the entire volume was pipetted under 6 mL GBSS/BSA in order to generate a discontinuous density gradient. Following centrifugation for 20 min at 1,400 g with the brake set at zero, the desired cells were harvested from the interface between the two density volumes and washed once with PBS and once with DMEM medium supplemented with 2 mM L-glutamine, 10% fetal bovine serum, and 1% amphotericin-B (complete DMEM). Cells were immortalized using Lenti-SV40 (Capital Biosciences, Cat. No. CIP-0011) using manufacturer's protocol. The resulting cell line, designated PSC4, were maintained in tissue culture as an adherent monolayer in complete DMEM at 37° C. and 5% $CO_2$. The MH194 mouse pancreatic carcinoma cells are derived from the KrasLSL.G12D/+p53R172H/+PdxCretg/+ genetically engineered mouse model.

To generate the MH194+PSC4 syngeneic tumor model, mice (male C57BL/6 mice obtained at 4-6 weeks from Taconic Farms and housed 4/cage) were injected with 50 µL of cell suspension containing parental MH194 cells along with $5\times10^5$ PSC4 ($5\times10^6$ cells total) intramuscularly, adjacent to the right tibial periosteum.

Thirty-nine (39) male C57BL/6 mice were co-inoculated subcutaneously with $5\times10^6$ of a mixture of murine MH194 pancreatic cancer tumor cells and murine PSC4 pancreatic stellate cells in 0.1 mL injection volume per animal. Tumor volume was determined using digital calipers via measurement of length (L) and width (W) of the solid tumor masses. Tumor volume (TV) was calculated as: $(L\times W^2)/2$. Tumors were allowed to grow and tumor bearing mice were staged for test article administration when the tumors were palpable and measured to be approximately 50-100 mm³.

PEG-R222Q/S265N was prepared using similar methods as described in Example 8.A, with minor modifications to generate a preparation in which approximately 100% of the molecules were PEGylated as assessed by SDS-PAGE. Briefly, a preparation of rHuADA2-R222Q/S265N (R219Q/S262N by mature numbering) at 10 mg/mL was mixed with linear PEG-20K (JenKem Technology, Plano, Tex.; Cat. No. M-SCM-20K) at 1:15 molar ratio and incubated first at 4° C. for 16 hours, and then at 30° C. for 60 min.

For treatment, MH194+PSC4 tumor bearing mice were randomized into five treatment groups (n=≤8); vehicle control (buffer only) or PEG-R222Q/S265N at four treatment doses. MH194+PSC4 tumor bearing mice were then injected intravenously (IV) every other day, at 0.003 mg/kg body weight, 0.03 mg/kg body weight, 0.3 mg/kg body weight and 3 mg/kg body weight of PEG-R222Q/S265N, or vehicle. Tumor volume was measured at day 0 and 8 using caliper measurement as described above. Percent Tumor Growth Inhibition (TGI) for each respective tumor model was calculated using the following equation:

$$\% \text{ TGI} = [1-(T_n-T_0) \div (C_n-C_0)] \times 100\%$$

where "$T_n$" is the average tumor volume for the treatment group at day "n" after the final dose of PEG-R222Q/S265N or control; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment. Median survival time (MST) (in days) was calculated as the time at which 50% of the mice of the individual groups reached one of the following endpoints: (1) tumor volume reaches 2000 mm³, (2) the animal loses >25% of its body weight, or (3) the animal appears moribund.

B. Results

Table 47 sets forth the results of the average tumor volume and tumor growth inhibition at day 11 in the mice administered with PEG-R222Q/S265N compared to vehicle control. At day 11, the average tumor volume for the vehicle control group was approximately 840 mm³. For the group treated with PEG-R222Q/S265N (0.003 mg/kg), the average tumor volume was approximately 324 mm³, a tumor growth inhibition (TGI) of approximately 72% (n=8; p=0.036), relative to the control group, demonstrating that PEG-R222Q/S265N administration results in significant tumor growth inhibition.

Table 48 sets forth the results of the median survival time of the mice administered PEG-R222Q/S265N, relative to the vehicle control group. All mice in the control group died between day 13 and day 36, resulting in a median survival time (MST) of 27 days. Five out of eight PEG-R222Q/S265N injected mice (at the 0.003 mg/kg dose) survived beyond 41 days, with an MST of 46 days for PEG-R222Q/S265N treated mice, at the 0.003 mg/kg dose. The results indicate that PEG-R222Q/S265N administration significantly prolongs survival in mice bearing MH194+PSC4 tumors.

TABLE 47

Tumor volume and tumor growth inhibition (TGI) in mice administered with PEG-R222Q/S265N

| Dose (mg/kg) | No. of Mice per group | Average Tumor Volume (mm³) | Tumor Growth Inhibition | p value (t-Test) compared to vehicle |
|---|---|---|---|---|
| Vehicle | 7 | 840.1 | 0% | |
| 0.003 | 8 | 323.9 | 72% | 0.0357 |
| 0.03 | 8 | 680.45 | 21% | 0.56 |
| 0.3 | 8 | 700.59 | 20% | 0.6 |
| 3 | 8 | 678.58 | 22% | 0.53 |

TABLE 48

Median Survival Time (MST) in mice administered with PEG-R222Q/S265N

| Dose (mg/kg) | No. of Mice per group | Survival time (days) | MST (days) | Increase in MST | **p value (Log-rank) compared to vehicle |
|---|---|---|---|---|---|
| Vehicle | 7 | 13-36 | 27 | — | |
| 0.003 | 8 | 22-48+ | 46 | 70% | 0.041 |
| 0.03 | 8 | 13-48+ | 26 | 0% | 0.72 |
| 0.3 | 8 | 13-41 | 32.5 | 20% | 0.49 |
| 3 | 8 | 13-48+ | 23.5 | 0% | 0.83 |

**Log-rank (Mantel-Cox) test

Example 21

Tumor Growth Inhibition (TGI) Assessment of Combination Therapy with PEGylated rHuADA2 and Anti-PD-1

The murine lung cancer KLN205 syngeneic tumor model was used to compare the antitumor activity of PEGylated ADA2-K374D (PEG-K374D; PEG-K371D by mature numbering) combined with checkpoint inhibitor anti-PD-1 antibody.

KLN205 syngeneic tumor models were produced by injecting thirty-two (32) DBA/2 mice with $5 \times 10^5$ KLN205 murine lung cancer tumor cells (ATCC CRL-1453), in 0.1 mL injection volume per animal, subcutaneously. Tumor bearing mice were staged into treatment groups when the average tumor size reached approximately 100 mm³.

For treatment, animals were randomized into 4 groups (n=8/group): 1) saline vehicle control, 2) PEG-K374D, 3) α-PD-1 antibody (Clone RMP1-14, Cat. No. BE0146; BioXCell, West Lebanon, N.H.), or 4) PEG-K374D+α-PD-1. PEG-K374D was dosed intravenously biweekly at 0.3 mg/kg, and α-PD-1 was dosed intraperitoneally biweekly at 2 mg/kg). The sequence of dosing in the combination group was PEG-K374D immediately followed by α-PD-1.

Tumor volume was measured twice weekly using caliper measurement as described above in Example 17.A. Percent Tumor Growth Inhibition (TGI) for each respective tumor model was calculated using the following equation:

$$\% \text{ TGI} = [1 - (T_n - T_0) \div (C_n - C_0)] \times 100\%$$

where "$T_n$" is the average tumor volume for the treatment group at day "n" after the final dose of PEG-K374D and α-PD-1 or control; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment.

The results are presented in Table 49. Table 49 depicts the average tumor volume per group, on study day 14 (SD14). The results show that PEG-K374D alone, α-PD-1 alone and the combination of PEG-K374D+α-PD-1 all inhibited tumor growth, compared to the control group. PEG-K374D alone exhibited greater tumor growth inhibition than either α-PD-1 treatment alone or the PEG-K374D+α-PD-1 combination therapy.

TABLE 49

Tumor Growth Inhibition of Combination Therapy in KLN205 Tumor Model

| Dose | No. of Mice per group | Average Tumor Volume (mm³) | Tumor Growth Inhibition | p value (t-Test) compared to vehicle |
|---|---|---|---|---|
| Vehicle | 8 | 899.41 | 0% | |
| PEG-K374D, 0.3 mg/kg | 8 | 264.56 | 78% | 0.013 |
| α-PD-1, 2 mg/kg | 8 | 545.73 | 43% | 0.16 |
| PEG-K374D + α-PD-1 | 8 | 417.79 | 59% | 0.053 |

Example 22

Removal of Free PEGylation Moieties

Unconjugated, free PEGylation moieties were removed from reactions to PEGylate ADA2 variants using the Capto Phenyl resin columns. Free PEG was removed from the preparations of PEGylated ADA2-K374D (PEG-K374D; PEG-K371D by mature numbering) and PEGylated rHuADA2-R222Q/S265N (PEG-R222Q/S265N; PEG-R219Q/S262N by mature numbering), prepared using the PEGylation method as described in Examples 8.A and 20.A.

To remove free PEG from the PEG-K374D (polypeptide of SEQ ID NO:20) preparation, 3.5M ammonium sulfate was added to the PEG-K374D in PBS to achieve a final concentration of 0.70 M ammonium sulfate in PBS. The PEG-K374D with ammonium sulfate was then applied to a Capto Phenyl resin column (GE Healthcare) pre-equilibrated with 0.70M ammonium sulfate in PBS, at a ratio of 5 mg PEGylated protein per ml of resin. The loaded Capto Phenyl resin was washed with 10 column volumes of 0.70M ammonium sulfate in PBS. The PEG-K374D was eluted with a decreasing gradient from 0.70M ammonium sulfate in PBS to 0 M ammonium sulfate in PBS. The fractions eluted after 40% gradient elution (0.42M ammonium sulfate in PBS) were pooled. The pooled elution fraction was concentrated to a concentration of 1 to 2 mg/mL, and analyzed by SDS-PAGE. Free PEG was detected using a Corona™ Charged Aerosol Detector (Thermo Scientific, Sunnyvale, Calif.).

To remove free PEG from PEG-R222Q/S265N (polypeptide of SEQ ID NO:273), 3.5M ammonium sulfate was added to the PEG-R222Q/S265N in PBS to achieve a final concentration of 0.64 M ammonium sulfate in PBS. The PEG-R222Q/S265N with ammonium sulfate was then applied to a Capto Phenyl resin column (GE Healthcare) pre-equilibrated with 0.64M ammonium sulfate in PBS, at a ratio of 5 mg PEGylated protein per ml of resin. The loaded Capto Phenyl resin was washed with 10 column volumes of 0.64M ammonium sulfate in PBS. The PEG-R222Q/S265N was eluted with a decreasing gradient from 0.64M ammonium sulfate in PBS to 0 M ammonium sulfate in PBS. The fractions eluted after 60% gradient elution (0.256M ammonium sulfate in PBS) were pooled. An additional elution with 20 column volumes of 15 mM sodium phosphate, pH 7.0 was also pooled with the first pooled elution fraction. The pooled elution fractions were concentrated to a concentration of 1 to 2 mg/mL, and analyzed by SDS-PAGE. Free PEG was detected using a Corona™ Charged Aerosol Detector (Thermo Scientific, Sunnyvale, Calif.).

The results of free PEG removal are presented in Table 50. The results show that the amount of free PEG decreased from approximately 3.7 mg free PEG/mg protein, to 0.13 mg free PEG/mg protein for the PEG-K374D preparation, and from 3.8 mg free PEG/mg protein to 0.2 mg/free PEG/mg protein for the PEG-R222Q/S265N preparation.

TABLE 50

Removal of free PEG from PEGylated ADA2 variant preparations

|  | PEG-K374D | PEG-R222Q/S265N |
|---|---|---|
| Starting protein amount | 6 mg | 50 mg |
| Free PEG before Capto Phenyl resin column | 3.7 mg free PEG/ mg protein | 3.8 mg free PEG/ mg protein |
| Free PEG after Capto Phenyl resin column | 0.13 mg free PEG/mg protein | 0.2 mg free PEG/ mg protein |
| Amount of protein recovered after free PEG removal | 4.5 mg | 28.5 mg |
| Protein recovery yield after free PEG removal | 75% | 57% |

Example 23

Multivesicular Liposome (MVL) PH20 Formulations

For systemic administration, hyaluronidases, including soluble hyaluronidases, can be prepared in lipids vesicles, such as liposomes. Exemplary of these are multivesicular liposomes (MVL). Various extended release multivesicular liposome PH20 (MVL-PH20) formulations were prepared using the following general procedure, see also, International PCT Pub. No. WO 2012/109387 and US Patent Pub. No. 2013/0251786. The lipid solutions contained mixtures of various neutral lipids, including triglycerides (TG) triolein ($C_{18:1}$), tricaprylin ($C_{8:0}$) and cholesterol, and lipids with both positive and negative charges, including phosphatidylcholines (PC), dioleoylphosphatidylcholine (DOPC, $C_{18:1}$), dierucoyl phosphatidylcholine (DEPC, $C_{22:1}$) and dipalmitoyl phosphorylglycerol (DPPG; $C_{16:1}$). Total PC concentration was up to 19.8 mM, cholesterol concentration was 30 mM, TG concentration was up to 3.9 mM and DPPG concentration was 4.2 mM.

A. Generation of MVL-PH20 Formulations

MVL formulations containing varying mole percent of DEPC and DOPC (0-100%) and varying mole percent of triolein and tricaprylin (0-100%), DPPG, cholesterol, and 0.1, 0.25, 0.5, 1 or 2 mg/mL PH20 were prepared. In the first step, the lipids in chloroform (oil phase) and PH20 in a first aqueous solution (water phase) were combined and emulsified to form a water-in-oil emulsion, whereby the PH20 was encapsulated by the phospholipid monolayer. In the second step, a second aqueous solution was added and emulsified, whereby a water-in-oil-in-water emulsion was formed. After addition of a second aliquot of the second aqueous solution, the chloroform solvent was evaporated and the resulting product containing multivesicular liposomes was washed multiple times in a third aqueous solution and resuspended to approximately 50% lipocrit (packed particle volume) and stored at 2-8° C.

Exemplary formulations were prepared using either a mini vortex or were prepared on a larger scale using an Omni mixer (Omni Macro ES, Omni International, Kennesaw, Ga.). In the latter Omni mixer method, the lipid solution in chloroform (6 mL) was emulsified at 7,000 rpm for 8 min with an Omni Mixer with 6 mL of the first aqueous solution (10 mM His-HCl, pH 6.5 with 5% sucrose containing varying concentrations of PH20) producing a water-in-oil emulsion. A subsequent emulsification at 4500 rpm for 1-3 min with 20 mL of a second aqueous solution of 3.2% glucose containing 40 mM lysine, pH 10.0, resulted in a water-in-oil-in-water second emulsion. The second emulsion was transferred equally into two Erlenmeyer flasks and another 50 mL aliquot of the second aqueous solution was added to both flasks. Chloroform was removed by flushing nitrogen over the surface of the emulsion at 35° C. The MVL particles containing PH20 were washed three times with 50 mL third aqueous solution (25 mM His-HCl buffer, pH 6.0 containing 120 mM NaCl) by adding the solution, mixing the centrifuge tube by inversion, and centrifugation at 3500 rpm for 10 min at 4° C. in a refrigerated table top centrifuge. Finally, the MVL particles were resuspended in the third aqueous solution to form an approximately 50% lipocrit formulation and stored refrigerated at 2-8° C. The mini vortex procedure was similar, using the parameters set forth in Table 30.

Table 51 below summarizes the first, second and third aqueous solutions. Table 51 also summarizes the volumes, reagent concentrations and other parameters of each step of the MVL process.

TABLE 51

MVL-PH20 formulation and process parameters

| 1st Aqueous Solution | 10 mM His-HCl, pH 6.5 with 5% sucrose | | | | |
|---|---|---|---|---|---|
| 2nd Aqueous Solution | 3.2% glucose containing 40 mM lysine, pH 10.0 | | | | |
| 3rd Aqueous Solution | 25 mM His-HCl buffer, pH 6.0 containing 120 mM NaCl | | | | |
| $1^{st}$ Emulsion Mixing | Vortex Mixer | | Omni Mixer | | |
| PH20 in 1st aqueous solution | 600 μL | | 6 mL | | |
| Lipid Solution in chloroform | 600 μL | | 6 mL | | |
| Total Volume | 1.2 mL | | 12 mL | | |
| $1^{st}$ Emulsification Speed | Maximum RPM | | 7000 RPM | | |
| Time | 8 min | | 8 min | | |
| Starting PH20 protein concentration (activity) | 0.25 mg/mL (30,000 U/mL) | 0.5 mg/mL (60,000 U/mL) | 0.5 mg/mL (60,000 U/mL) | 1.0 mg/mL (120,000 U/mL) | 2.0 mg/mL (240,000 U/mL) |
| PC | 15.8-19.8 mM | | 15.8-19.8 mM | | |
| Cholesterol | 30 mM | | 30 mM | | |
| TG | 3.75-3.9 mM | | 3.75-3.9 mM | | |
| DPPG | 4.2 mM | | 4.2 mM | | |
| Blade Type 1 | Not applicable | | Sharp on the sides | | |
| Blade Type 2 | Not applicable | | Sharp on the sides and on the inside | | |

TABLE 51-continued

| MVL-PH20 formulation and process parameters | | |
|---|---|---|
| Blade Type 3 | Not applicable | Flat all over, not sharp |
| 2$^{nd}$ Emulsion Mixing | Vortex Mixer | Omni Mixer |
| 2nd Aqueous Solution | 2.5 mL | 20 mL |
| Total Volume | 3.7 mL | 32 mL |
| Speed | Maximum RPM | 4500 RPM |
| Time | 15 sec | 1-3 min |
| Solvent Evaporation | Vortex Mixer | Omni Mixer |
| 2nd Aqueous Solution | 10 mL | 100 mL |
| Total Volume | 13.7 mL | 132 mL |
| Shaking Water Bath Speed | 100-130 RPM | 100-130 RPM |
| Time | 11 min | 15 min |
| Temperature | 35° C. | 35° C. |
| Washing, buffer exchange and resuspension | Vortex Mixer | Omni Mixer |
| Sample | Entire Sample | 17 mL |
| 3rd Aqueous Solution | 50 mL | 50 mL |
| Total Volume | 50 mL | 200 mL |
| Centrifugation Speed | 3500 RPM | 3500 RPM |
| Time | 10 min | 10 min |
| Number of Washes | 3 | 3 |
| Resuspension Volume | 0.3-0.5 mL | 3-5 mL |
| LIPOCRIT | Vortex Mixer | Omni Mixer |
| Pellet volume | Varies | Varies |
| 3rd Aqueous Solution | Varies | Varies |
| Speed | 3500 rpm | 3500 rpm |
| Time (min) | 10 min | 10 min |
| Solution + Pellet Volume | Varies | Varies |
| % Lipocrit Adjusted to | ~50% | ~50% |

B. Summary of Exemplary MVL-PH20 Formulations

Several MVL-PH20 formulations containing varying molar ratios of lipids, PH20 and other additives were prepared using the same general procedures as described above. The various additional additives were included in the first aqueous solution to enhance and preserve the stability of encapsulated PH20. For example, formulations F68 and F69 contained calcium chloride. Formulation F82 contained 150 µL glycerol as an interphase separating the 600 µL chloroform phase and 600 µL first aqueous solution phase. Formulation F83 contained 0.1% dextran 40,000 and 0.1% PEG-6000. Formulations F85-F87 contained hyaluronic acid (HA) oligomers. Several formulations varied in their mixing/emulsification procedures. For example, for formulation F66, the first emulsification step was carried out for 4 minutes, instead of 8 minutes, resulting in smaller liposomal pellets. Formulation F67 was mixed with a rotor wheel, instead of a mini vortex to generate lesser shear during mixing.

Table 52 below sets forth various MVL-PH20 formulations, including the formulation number, the formulation PC (phosphatidylcholine) and TG (triglyceride) molar % ratios, the starting concentration of PH20 in mg/mL, the mixer used for making the emulsions, and any additives that were included in the first aqueous solution.

TABLE 52

| MVL Formulations with PH20 | | | | |
|---|---|---|---|---|
| Formulation | Formulation PC & TG mol % ratio | Starting PH20 concentration mg/mL | Mixer | Additives in First Aqueous Solution |
| F40 | DEPC with Triolein | 0.25 | Mini Vortex | N/A |
| F41 | DEPC with Triolein | 0 | Mini Vortex | N/A |
| F42 | DEPC with Triolein | 0.25 fluorescent labeled | Mini Vortex | AlexaFluor 488 labeled PH20 |
| F53 | 25/75 DEPC/DOPC; 25/75 Triolein/Tricap | 0.25 | Mini Vortex | N/A |
| F54 | 50/50 DEPC/DOPC; 50/50 Triolein/Tricap | 0.25 | Mini Vortex | N/A |
| F55 | 75/25 DEPC/DOPC; 75/25 Triolein/Tricap | 0.25 | Mini Vortex | N/A |
| F56 | 90/10 DEPC/DOPC; 90/10 Triolein/Tricap | 0.25 | Mini Vortex | N/A |
| F61 | 50/50 DEPC/DOPC; 50/50 Triolein/Tricap | 0.25 | Omni | N/A |
| F66 | 50/50 DEPC/DOPC; 50/50 Triolein/Tricap | 0.25 | Mini Vortex[1] | N/A |

TABLE 52-continued

MVL Formulations with PH20

| Formulation | Formulation PC & TG mol % ratio | Starting PH20 concentration mg/mL | Mixer | Additives in First Aqueous Solution |
|---|---|---|---|---|
| F67 | 50/50 DEPC/DOPC; 50/50 Triolein/Tricap | 0.25 | Rotor Wheel | N/A |
| F68 | 50/50 DEPC/DOPC; 50/50 Triolein/Tricap | 0.25 | Mini Vortex | 20 mM CaCl$_2$ |
| F69 | 50/50 DEPC/DOPC; 50/50 Triolein/Tricap | 0.25 | Mini Vortex | 10 mM CaCl$_2$ |
| F70 | 50/50 DEPC/DOPC; 50/50 Triolein/Tricap | 0.0 | Omni | N/A |
| F71 | 50/50 DEPC/DOPC; 50/50 Triolein/Tricap | 0.25 | Omni | N/A |
| F72 | 50/50 DEPC/DOPC; 50/50 Triolein/Tricap | 0.5 | Omni | N/A |
| F73 | 50/50 DEPC/DOPC; 50/50 Triolein/Tricap | 0.5 | Omni | N/A |
| F74 | 50/50 DEPC/DOPC; 50/50 Triolein/Tricap | 1.0 | Omni | N/A |
| F75 | 50/50 DEPC/DOPC; 50/50 Triolein/Tricap | 2.0 | Omni | N/A |
| F77[2] | 50/50 DEPC/DOPC; 50/50 Triolein/Tricap | 1.0 | Omni | |
| F78 | DEPC with Triolein | 1.0 | Omni | N/A |
| F79 | DEPC with Triolein | 1.0 | Omni | N/A |
| F80 | 50/50 DEPC/DOPC; 50/50 Triolein/Tricap | 1.0 | Omni | N/A |
| F81 | DEPC with Triolein | 0.5 | Omni | N/A |
| F82 | 50/50 DEPC/DOPC; 50/50 Triolein/Tricap | 0.5 | Mini Vortex | 150 μL Glycerol as interphase |
| F83 | 50/50 DEPC/DOPC; 50/50 Triolein/Tricap | 1.0 | Omni | 0.1% Dextran 40,000 0.1% PEG-6000 |
| F84 | 50/50 DEPC/DOPC; 50/50 Triolein/Tricap | 1.0 | Omni[3] | N/A |
| F85 | 50/50 DEPC/DOPC; 50/50 Triolein/Tricap | 1.0 | Omni | 15 mg/mL HA 74,000 |
| F85R1 | 50/50 DEPC/DOPC; 50/50 Triolein/Tricap | 1.0 | Omni | 15 mg/mL HA 74,000 |
| F86 | 50/50 DEPC/DOPC; 50/50 Triolein/Tricap | 1.0 | Omni | 50 mg/mL HA 74,000 |
| F87 | 50/50 DEPC/DOPC; 50/50 Triolein/Tricap | 1.0 | Omni | 100 mM Proline |
| F88 | 50/50 DEPC/DOPC; 50/50 Triolein/Tricap | 1.0 | Omni | 100 mM Arg-HCl, pH 6.44 |
| F89 | 50/50 DEPC/DOPC; 50/50 Triolein/Tricap | 1.0 | Omni | 6% Sorbitol |
| F90 | 50/50 DEPC/DOPC; 50/50 Triolein/Tricap | 1.0 | Omni | 6% Trehalose |

[1] Shorter first emulsion mixing time (4 min)
[2] Animal derived cholesterol used instead of plant derived cholesterol in the lipid solution
[3] Shorter first emulsion mixing time (4 min) and shorter second emulsion mixing time (30 sec)

Example 24

PEGADA2 Variant R222Q/S265N Significantly Reduces Adenosine in MH194+PSC4 Tumor Extracellular Matrix To assess the effects of PEGADA2 on adenosine in tumor extracellular matrix, mice bearing peritibial MH194+PSC4 tumors received vehicle, the polypeptide whose sequence is set forth in SEQ ID NO:20, which contains the amino acid replacement K374D (Zavialov numbering; K371D mature numbering), at 0.03 mg/kg, or the polypeptide whose sequence is set forth in SEQ ID NO: 273, which contains the amino acid replacements R222Q/S265N (Zavialov numbering; R219Q/S262 mature numbering), at 0.03 mg/kg, 24 or 48 hours prior to microdialysis. Each of the polypeptides were PEGylated as described above in Examples 8 and 22).

The mice were anesthetized using isofluorane, and a heating pad was used to maintain body temperature. A small incision was made on the tumor. A microdialysis probe with 55,000 Da molecular weight cut-off (CMA, Stockholm, Sweden) was inserted into the tumor, via a guided cannula. The length of the microdialysis probe used in this study was 10 mm. Once the probe was in position, the cannula was withdrawn leaving the probe completely embedded in the tumor tissue. Dulbecco's phosphate buffered saline (DPBS; Thermo Fisher Scientific) with ADA inhibitors (Pentostatin and 5-iodotubercindin) was perfused through the probe at a flow rate of 1 μl/min for 30 minutes. Then the samples were collected at a flow rate of 0.5 μl/min for 60 minutes. Microdialysis perfusates were analyzed by Liquid chromatography-mass spectrometry (LC/MS) at MicroConstants (9050 Camino Santa Fe, San Diego, Calif. 92121).

LC/MS analysis reveals average concentration of adenosine in MH194+PSC4 peritibial tumors was 17.8 μM (n=8).

24 hours post K374D treatment, adenosine concentration was 19.5 μM (n=8), which is above control due to outlier value from one tumor (49 μM). The trend toward reduced adenosine (11 μM) was observed in K374D-treated mice at 48 hours. In contrast, the adenosine is significantly reduced to 6.9 μM (n=8) at 24 hours and 9.8 μM (n=8) at 48 hours post R222Q/S265N treatment (P≤0.05).

TABLE 53

R222Q/S265N reduces adenosine in tumor ECM

| Group (n = 8) | Adenosine (μM) Mean ± SD | P |
|---|---|---|
| Vehicle control | 17.8 ± 6.1 | — |
| NME8 @ 24 hours | 19.5 ± 15.3 | >0.05 |
| NME8 @ 48 hours | 11.1 ± 10.9 | >0.05 |
| NME62 @ 24 hours | 6.9 ± 9.0 | ≤0.05 |
| NME62 @ 48 hours | 9.8 ± 8.3 | ≤0.05 |

TABLE 54

Adenosine concentration (μM) in ECM

| | Vehicle control | K374D @ 24 hours | K374D @ 48 hours | R222Q/ S265N @ 24 hours | R222Q/ S265N @ 48 hours |
|---|---|---|---|---|---|
| | 14.33 | 7.48 | 1.64 | 21.48 | 4.15 |
| | 11.08 | 2.04 | 27.54 | 0.48 | 14.26 |
| | 10.48 | 29.30 | 5.95 | 5.80 | 3.43 |
| | 24.43 | 49.02 | 23.13 | 0.08 | 13.06 |
| | 16.17 | 12.72 | 0.07 | 20.54 | 1.96 |
| | 17.25 | 29.64 | 6.47 | 1.08 | 20.36 |
| | 21.85 | 13.58 | 2.77 | 0.62 | 20.62 |
| | 27.02 | 12.54 | 20.92 | 4.94 | 0.35 |
| Mean | 17.83 | 19.54 | 11.06 | 6.88 | 9.77 |
| SD | 6.09 | 15.35 | 10.95 | 8.98 | 8.30 |
| P (t-test) | | 0.77 | 0.15 | 0.01 | 0.04 |

Example 25

Tabular Summary of Exemplary ADA2 Variants and Region of the Protein Modified

Table 55 provides a summary of the variant ADA2 polypeptides exemplified herein. The table provides the position of modification based on Zavialov and mature sequence numbering, and an exemplary SEQ ID NOS: of an ADA2 variant protein that contains such modification. It is understood that modifications can be combined and that additional variants are contemplated. The noted amino acid residues generally can be replaced with conservative amino acid substitutions (see, e.g., Table 3), except in instances, such as hyperglycosylation where a conservative substitution will not create a glycosylation site. Hence, for example, N can be replaced with Q or H. ADA2 variant polypeptides comprising each of the noted modifications are provided. Included among these are the polypeptides whose sequence is referenced with a sequence identifier. Combinations of any of the modifications also are provided. Also provided are modified ADA2 variant dimers, including homodimers and heterodimers. Also provided are multimers of the variants. Also provide are conjugates containing the variants and multimers and dimers, as are methods of treatment, uses for treatment, combinations and pharmaceutical compositions as described herein. The last column identifies the region or domain of the modification, or the activity the modification confers. In general, the mutations, for example, increase activity, decrease heparin binding, introduce glycosylation to interfere with undesirable interactions and/or to increase serum half-life, interfere with or decrease interactions of the PRB domain with the ADA catalytically active portions and/or decrease activities other than the deaminase activity, such as growth factor activity of ADA2 by interfering with binding to receptors that mediate such activities.

TABLE 55

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| K14A | K11A | 13 | Heparin Binding |
| K14D | K11D | 14 | Heparin Binding |
| K14E | K11E | 15 | Heparin Binding |
| K16A | K13A | 16 | Heparin Binding |
| K16D | K13D | 17 | Heparin Binding |
| K16E | K13E | 18 | Heparin Binding |
| K374A | K371A | 19 | Heparin Binding |
| K374D | K371D | 20 | Heparin Binding |
| K374E | K371E | 21 | Heparin Binding |
| K375A | K372A | 22 | Heparin Binding |
| K375D | K372D | 23 | Heparin Binding |
| K375E | K372E | 24 | Heparin Binding |
| K455A | K452A | 25 | Heparin Binding |
| K455D | K452D | 26 | Heparin Binding |
| K455E | K452E | 27 | Heparin Binding |
| R23A | R20A | 28 | Heparin Binding |
| R23D | R20D | 29 | Heparin Binding |
| R23E | R20E | 30 | Heparin Binding |
| R369A | R366A | 31 | Heparin Binding |
| R369D | R366D | 32 | Heparin Binding |
| R369E | R366E | 33 | Heparin Binding |
| H267A | H264A | 34 | Active Site |
| H267Q | H264Q | 35 | Active Site |
| H267N | H264N | 36 | Active Site |
| H267G | H264G | 37 | Active Site |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222K | R219K | 38 | Active Site |
| R222Q | R219Q | 39 | Active Site |
| R222N | R219N | 40 | Active Site |
| R222A | R219A | 41 | Active Site |
| L224A | L221A | 42 | Active Site |
| L224V | L221V | 43 | Active Site |
| L224G | L221G | 44 | Active Site |
| E182D | E179D | 45 | Active Site |
| E182A | E179A | 46 | Active Site |
| E182S | E179S | 47 | Active Site |
| E182T | E179T | 48 | Active Site |
| E182V | E179V | 49 | Active Site |
| E182G | E179G | 50 | Active Site |
| S265A | S262A | 51 | Active Site |
| S265V | S262V | 52 | Active Site |
| S265M | S262M | 53 | Active Site |
| S265N | S262N | 54 | Active Site |
| K14A/R23A | K11A/R20A | 55 | Combination |
| K14A/R23A/K374A | K11A/R20A/K371A | 56 | Combination |
| R23A/K374A | R20A/K371A | 57 | Combination |
| K14A/K374A | K11A/K371A | 58 | Combination |
| S265N/K374D | S262N/K371D | 59 | Combination |
| S265N/K374E | S262N/K371E | 60 | Combination |
| S265N/R23E | S262N/R20E | 61 | Combination |
| S265N/R23E/K374D | S262N/R20E/K371D | 62 | Combination |
| S265N/R23E/K374E | S262N/R20E/K371E | 63 | Combination |
| K29A | K26A | 71 | Heparin Binding |
| K29D | K26D | 72 | Heparin Binding |
| K29E | K26E | 73 | Heparin Binding |
| R220A | R217A | 74 | Heparin Binding |
| R220D | R217D | 75 | Heparin Binding |
| R220E | R217E | 76 | Heparin Binding |
| K261A | K258A | 77 | Heparin Binding |
| K261D | K258D | 78 | Heparin Binding |
| K261E | K258E | 79 | Heparin Binding |
| R280A | R277A | 80 | Heparin Binding |
| R280D | R277D | 81 | Heparin Binding |
| R280E | R277E | 82 | Heparin Binding |
| R286A | R283A | 83 | Heparin Binding |
| R286D | R283D | 84 | Heparin Binding |
| R286E | R283E | 85 | Heparin Binding |
| K312A | K309A | 86 | Heparin Binding |
| K312D | K309D | 87 | Heparin Binding |
| K312E | K309E | 88 | Heparin Binding |
| K320A | K317A | 89 | Heparin Binding |
| K320D | K317D | 90 | Heparin Binding |
| K320E | K317E | 91 | Heparin Binding |
| K324A | K321A | 92 | Heparin Binding |
| K324D | K321D | 93 | Heparin Binding |
| K324E | K321E | 94 | Heparin Binding |
| R355A | R352A | 95 | Heparin Binding |
| R355D | R352D | 96 | Heparin Binding |
| R355E | R352E | 97 | Heparin Binding |
| R444A | R441A | 98 | Heparin Binding |
| R444D | R441D | 99 | Heparin Binding |
| R444E | R441E | 100 | Heparin Binding |
| K447A | K444A | 101 | Heparin Binding |
| K447D | K444D | 102 | Heparin Binding |
| K447E | K444E | 103 | Heparin Binding |
| K464A | K461A | 104 | Heparin Binding |
| K464D | K461D | 105 | Heparin Binding |
| K464E | K461E | 106 | Heparin Binding |
| K472A | K469A | 107 | Heparin Binding |
| K472D | K469D | 108 | Heparin Binding |
| K472E | K469E | 109 | Heparin Binding |
| K473A | K470A | 110 | Heparin Binding |
| K473D | K470D | 111 | Heparin Binding |
| K473E | K470E | 112 | Heparin Binding |
| D89A | D86A | 113 | Active Site |
| D89C | D86C | 114 | Active Site |
| D89E | D86E | 115 | Active Site |
| D89F | D86F | 116 | Active Site |
| D89G | D86G | 117 | Active Site |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| D89H | D86H | 118 | Active Site |
| D89I | D86I | 119 | Active Site |
| D89K | D86K | 120 | Active Site |
| D89L | D86L | 121 | Active Site |
| D89M | D86M | 122 | Active Site |
| D89N | D86N | 123 | Active Site |
| D89P | D86P | 124 | Active Site |
| D89Q | D86Q | 125 | Active Site |
| D89R | D86R | 126 | Active Site |
| D89S | D86S | 127 | Active Site |
| D89T | D86T | 128 | Active Site |
| D89V | D86V | 129 | Active Site |
| D89W | D86W | 130 | Active Site |
| D89Y | D86Y | 131 | Active Site |
| E182C | E179C | 132 | Active Site |
| E182F | E179F | 133 | Active Site |
| E182H | E179H | 134 | Active Site |
| E182I | E179I | 135 | Active Site |
| E182K | E179K | 136 | Active Site |
| E182L | E179L | 137 | Active Site |
| E182M | E179M | 138 | Active Site |
| E182N | E179N | 139 | Active Site |
| E182P | E179P | 140 | Active Site |
| E182Q | E179Q | 141 | Active Site |
| E182R | E179R | 142 | Active Site |
| E182W | E179W | 143 | Active Site |
| E182Y | E179Y | 144 | Active Site |
| R222C | R219C | 145 | Active Site |
| R222D | R219D | 146 | Active Site |
| R222E | R219E | 147 | Active Site |
| R222F | R219F | 148 | Active Site |
| R222G | R219G | 149 | Active Site |
| R222H | R219H | 150 | Active Site |
| R222I | R219I | 151 | Active Site |
| R222L | R219L | 152 | Active Site |
| R222M | R219M | 153 | Active Site |
| R222P | R219P | 154 | Active Site |
| R222S | R219S | 155 | Active Site |
| R222T | R219T | 156 | Active Site |
| R222V | R219V | 157 | Active Site |
| R222W | R219W | 158 | Active Site |
| R222Y | R219Y | 159 | Active Site |
| L224C | L221C | 160 | Active Site |
| L224D | L221D | 161 | Active Site |
| L224E | L221E | 162 | Active Site |
| L224F | L221F | 163 | Active Site |
| L224H | L221H | 164 | Active Site |
| L224I | L221I | 165 | Active Site |
| L224K | L221K | 166 | Active Site |
| L224M | L221M | 167 | Active Site |
| L224N | L221N | 168 | Active Site |
| L224P | L221P | 169 | Active Site |
| L224Q | L221Q | 170 | Active Site |
| L224R | L221R | 171 | Active Site |
| L224S | L221S | 172 | Active Site |
| L224T | L221T | 173 | Active Site |
| L224W | L221W | 174 | Active Site |
| L224Y | L221Y | 175 | Active Site |
| S265C | S262C | 176 | Active Site |
| S265D | S262D | 177 | Active Site |
| S265E | S262E | 178 | Active Site |
| S265F | S262F | 179 | Active Site |
| S265G | S262G | 180 | Active Site |
| S265H | S262H | 181 | Active Site |
| S265I | S262I | 182 | Active Site |
| S265K | S262K | 183 | Active Site |
| S265L | S262L | 184 | Active Site |
| S265P | S262P | 185 | Active Site |
| S265Q | S262Q | 186 | Active Site |
| S265R | S262R | 187 | Active Site |
| S265T | S262T | 188 | Active Site |
| S265W | S262W | 189 | Active Site |
| S265Y | S262Y | 190 | Active Site |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| H267C | H264C | 191 | Active Site |
| H267D | H264D | 192 | Active Site |
| H267E | H264E | 193 | Active Site |
| H267F | H264F | 194 | Active Site |
| H267I | H264I | 195 | Active Site |
| H267K | H264K | 196 | Active Site |
| H267L | H264L | 197 | Active Site |
| H267M | H264M | 198 | Active Site |
| H267P | H264P | 199 | Active Site |
| H267R | H264R | 200 | Active Site |
| H267S | H264S | 201 | Active Site |
| H267T | H264T | 202 | Active Site |
| H267V | H264V | 203 | Active Site |
| H267W | H264W | 204 | Active Site |
| H267Y | H264Y | 205 | Active Site |
| S269A | S266A | 206 | Active Site |
| S269C | S266C | 207 | Active Site |
| S269D | S266D | 208 | Active Site |
| S269E | S266E | 209 | Active Site |
| S269F | S266F | 210 | Active Site |
| S269G | S266G | 211 | Active Site |
| S269H | S266H | 212 | Active Site |
| S269I | S266I | 213 | Active Site |
| S269K | S266K | 214 | Active Site |
| S269L | S266L | 215 | Active Site |
| S269M | S266M | 216 | Active Site |
| S269N | S266N | 217 | Active Site |
| S269P | S266P | 218 | Active Site |
| S269Q | S266Q | 219 | Active Site |
| S269R | S266R | 220 | Active Site |
| S269T | S266T | 221 | Active Site |
| S269V | S266V | 222 | Active Site |
| S269W | S266W | 223 | Active Site |
| S269Y | S266Y | 224 | Active Site |
| K270A | K267A | 225 | Active Site |
| K270C | K267C | 226 | Active Site |
| K270D | K267D | 227 | Active Site |
| K270E | K267E | 228 | Active Site |
| K270F | K267F | 229 | Active Site |
| K270G | K267G | 230 | Active Site |
| K270H | K267H | 231 | Active Site |
| K270I | K267I | 232 | Active Site |
| K270L | K267L | 233 | Active Site |
| K270M | K267M | 234 | Active Site |
| K270N | K267N | 235 | Active Site |
| K270P | K267P | 236 | Active Site |
| K270Q | K267Q | 237 | Active Site |
| K270R | K267R | 238 | Active Site |
| K270S | K267S | 239 | Active Site |
| K270T | K267T | 240 | Active Site |
| K270V | K267V | 241 | Active Site |
| K270W | K267W | 242 | Active Site |
| K270Y | K267Y | 243 | Active Site |
| V299A | V296A | 244 | Active Site |
| V299C | V296C | 245 | Active Site |
| V299D | V296D | 246 | Active Site |
| V299E | V296E | 247 | Active Site |
| V299F | V296F | 248 | Active Site |
| V299G | V296G | 249 | Active Site |
| V299H | V296H | 250 | Active Site |
| V299I | V296I | 251 | Active Site |
| V299K | V296K | 252 | Active Site |
| V299L | V296L | 253 | Active Site |
| V299M | V296M | 254 | Active Site |
| V299N | V296N | 255 | Active Site |
| V299P | V296P | 256 | Active Site |
| V299Q | V296Q | 257 | Active Site |
| V299R | V296R | 258 | Active Site |
| V299S | V296S | 259 | Active Site |
| V299T | V296T | 260 | Active Site |
| V299W | V296W | 261 | Active Site |
| V299Y | V296Y | 262 | Active Site |
| R222Q/K374E | R219Q/K371E | 263 | Combination |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/K374D | R219Q/K371D | 264 | Combination |
| R222Q/R23E | R219Q/R20E | 265 | Combination |
| R222Q/K374E/R23E | R219Q/K371E/R20E | 266 | Combination |
| R222Q/K374D/R23E | R219Q/K371D/R20E | 267 | Combination |
| R222Q/S265N/K374E | R219Q/S262N/K371E | 268 | Combination |
| R222Q/S265N/K374D | R219Q/S262N/K371D | 269 | Combination |
| R222Q/S265N/R23E | R219Q/S262N/R20E | 270 | Combination |
| R222Q/S265N/K374E/R23E | R219Q/S262N/K371E/R20E | 271 | Combination |
| R222Q/S265N/K374D/R23E | R219Q/S262N/K371D/R20E | 272 | Combination |
| R222Q/S265N | R219Q/S262N | 273 | Combination |
| --→N4/--→A5/--→S6 | --→N1/--→A2/--→S3 | 274 | Hyperglycosylation |
| R23N/V25S | R20N/V22S | 275 | Hyperglycosylation |
| K374N/D376S | K371N/D373S | 276 | Hyperglycosylation |
| K375N/I377S | K372N/I374S | 277 | Hyperglycosylation |
| T406N/H408S | T403N/H405S | 278 | Hyperglycosylation |
| G407N/P409S | G404N/P406S | 279 | Hyperglycosylation |
| C108-T150del→(Gly)$_n$ | C105-T147del→(Gly)$_n$ | 280 | PRB deletion |
| C108-T150del→(Gly)$_{15}$ | C105-T147del→(Gly)$_{15}$ | 281 | PRB deletion |
| C108-T150del→(Gly)$_{10}$ | C105-T147del→(Gly)$_{10}$ | 282 | PRB deletion |
| C108-T150del→(Gly)$_7$ | C105-T147del→(Gly)$_7$ | 283 | PRB deletion |
| C108-T150del→(Gly)$_5$ | C105-T147del→(Gly)$_5$ | 284 | PRB deletion |
| C108-T150del→(Gly)$_3$ | C105-T147del→(Gly)$_3$ | 285 | PRB deletion |
| N101-N159del | N98-N156del | 548 | PRB deletion |
| C108-E151del | C105-E148del | 549 | PRB deletion |
| C108-T150del | C105-T147del | 550 | PRB deletion |
| R128N/P129A | R125N/P126A | 552 | PRB hyperglycosylation |
| S130N/K132S | S127N/K129S | 553 | PRB hyperglycosylation |
| P129N/E131T | P126N/E128T | 554 | PRB hyperglycosylation |
| R115N/I117T | R112N/I114T | 555 | PRB hyperglycosylation |
| I137N/L138C/L139T | I134N/L135C/L136T | 556 | PRB hyperglycosylation |
| I137N/L138S/L139T | I134N/L135S/L136T | 557 | PRB hyperglycosylation |
| R145N/Q147S | R142N/Q144S | 558 | PRB hyperglycosylation |
| E140N/Y142T | E137N/Y139T | 559 | PRB hyperglycosylation |
| P114N/G116S | P111N/G113S | 560 | PRB hyperglycosylation |
| F122S | F119S | 561 | PRB-ADA interaction |
| F122K | F119K | 562 | PRB-ADA interaction |
| Y227R | Y224R | 563 | PRB-ADA interaction |
| Y227N | Y224N | 564 | PRB-ADA interaction |
| Y194S | Y191S | 565 | PRB-ADA interaction |
| Y194D | Y191D | 566 | PRB-ADA interaction |
| F186K | F183K | 567 | PRB-ADA interaction |
| Y194D/Y227R | Y191D/Y224R | 568 | PRB-ADA interaction |
| F112S | F109S | 569 | PRB-ADA interaction |
| F112A | F109A | 570 | PRB-ADA interaction |
| R121D | R118D | 571 | PRB-ADA interaction |
| R121A | R118A | 572 | PRB-ADA interaction |
| Y142T | Y139T | 573 | PRB-ADA interaction |
| Y142A | Y139A | 574 | PRB-ADA interaction |
| W136S | W133S | 575 | PRB-ADA interaction |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| W136T | W133T | 576 | PRB-ADA interaction |
| P127A | P124A | 577 | PRB-ADA interaction |
| P127S | P124S | 578 | PRB-ADA interaction |
| V102-Q147del | V99-Q144del | 579 | PRB deletion |
| V102-Q147del→(GGGGS)n | V99-Q144del→(GGGGS)n | 581 | PRB deletion |
| C108-T150del→(GGGGS)n | C105-T147del→(GGGGS)n | 582 | PRB deletion |
| V102-Q147del→(GGGGS)$_1$ | V99-Q144del→(GGGGS)$_1$ | 583 | PRB deletion |
| V102-Q147del→(GGGGS)$_2$ | V99-Q144del→(GGGGS)$_2$ | 584 | PRB deletion |
| V102-Q147del→(GGGGS)$_3$ | V99-Q144del→(GGGGS)$_3$ | 585 | PRB deletion |
| C108-T150del→(GGGGS)$_1$ | C105-T147del→(GGGGS)$_1$ | 586 | PRB deletion |
| C108-T150del→(GGGGS)$_2$ | C105-T147del→(GGGGS)$_2$ | 587 | PRB deletion |
| C108-T150del→(GGGGS)$_3$ | C105-T147del→(GGGGS)$_3$ | 588 | PRB deletion |
| K374D/V102-Q147del→(GGGGS)$_1$ | K371D/V99-Q144del→(GGGGS)$_1$ | 589 | Combination w/ PRB deletion |
| K374D/V102-Q147del→(GGGGS)$_2$ | K371D/V99-Q144del→(GGGGS)$_2$ | 590 | Combination w/ PRB deletion |
| K374D/V102-Q147del→(GGGGS)$_3$ | K371D/V99-Q144del→(GGGGS)$_3$ | 591 | Combination w/ PRB deletion |
| K374D/C108-T150del→(GGGGS)$_1$ | K371D/C105-T147del→(GGGGS)$_1$ | 592 | Combination w/ PRB deletion |
| K374D/C108-T150del→(GGGGS)$_2$ | K371D/C105-T147del→(GGGGS)$_2$ | 593 | Combination w/ PRB deletion |
| K374D/C108-T150del→(GGGGS)$_3$ | K371D/C105-T147del→(GGGGS)$_3$ | 594 | Combination w/ PRB deletion |
| R222Q/S265N/--→N4/--→A5/--→S6 | R219Q/S262N/--→N1/--→A2/--→S3 | 596 | Combination w/ hyperglycosylation |
| R222Q/S265N/R23N/V25S | R219Q/S262N/R20N/V22S | 597 | Combination w/ hyperglycosylation |
| R222Q/S265N/K374N/D376S | R219Q/S262N/K371N/D373S | 598 | Combination w/ hyperglycosylation |
| R222Q/S265N/K375N/I377S | R219Q/S262N/K372N/I374S | 599 | Combination w/ hyperglycosylation |
| R222Q/S265N/T406N/H408S | R219Q/S262N/T403N/H405S | 600 | Combination w/ hyperglycosylation |
| R222Q/S265N/G407N/P409S | R219Q/S262N/G404N/P406S | 601 | Combination w/ hyperglycosylation |
| R222Q/S265N/C108-T150del→(Gly)$_{15}$ | R219Q/S262N/C105-T147del→(Gly)$_{15}$ | 602 | Combination w/ PRB deletion |
| R222Q/S265N/C108-T150del→(Gly)$_{10}$ | R219Q/S262N/C105-T147del→(Gly)$_{10}$ | 603 | Combination w/ PRB deletion |
| R222Q/S265N/C108-T150del→(Gly)$_7$ | R219Q/S262N/C105-T147del→(Gly)$_7$ | 604 | Combination w/ PRB deletion |
| R222Q/S265N/C108-T150del→(Gly)$_5$ | R219Q/S262N/C105-T147del→(Gly)$_5$ | 605 | Combination w/ PRB deletion |
| R222Q/S265N/C108-T150del→(Gly)$_3$ | R219Q/S262N/C105-T147del→(Gly)$_3$ | 606 | Combination w/ PRB deletion |
| R222Q/S265N/R128N/P129A | R219Q/S262N/R125N/P126A | 607 | Combination w/ PRB hyperglycosylation |
| R222Q/S265N/S130N/K132S | R219Q/S262N/S127N/K129S | 608 | Combination w/ PRB hyperglycosylation |
| R222Q/S265N/P129N/E131T | R219Q/S262N/P126N/E128T | 609 | Combination w/ PRB hyperglycosylation |
| R222Q/S265N/R115N/I117T | R219Q/S262N/R112N/I114T | 610 | Combination w/ PRB hyperglycosylation |
| R222Q/S265N/I137N/L138C/L139T | R219Q/S262N/I134N/L135C/L136T | 611 | Combination w/ PRB hyperglycosylation |
| R222Q/S265N/I137N/L138S/L139T | R219Q/S262N/I134N/L135S/L136T | 612 | Combination w/ PRB hyperglycosylation |
| R222Q/S265N/R145N/Q147S | R219Q/S262N/R142N/Q144S | 613 | Combination w/ PRB hyperglycosylation |
| R222Q/S265N/E140N/Y142T | R219Q/S262N/E137N/Y139T | 614 | Combination w/ PRB hyperglycosylation |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/S265N/P114N/G116S | R219Q/S262N/P111N/G113S | 615 | Combination w/ PRB hyperglycosylation |
| R222Q/S265N/F122S | R219Q/S262N/F119S | 616 | Combination w/ PRB-ADA interaction |
| R222Q/S265N/F122K | R219Q/S262N/F119K | 617 | Combination w/ PRB-ADA interaction |
| R222Q/S265N/Y227R | R219Q/S262N/Y224R | 618 | Combination w/ PRB-ADA interaction |
| R222Q/S265N/Y227N | R219Q/S262N/Y224N | 619 | Combination w/ PRB-ADA interaction |
| R222Q/S265N/Y194S | R219Q/S262N/Y191S | 620 | Combination w/ PRB-ADA interaction |
| R222Q/S265N/Y194D | R219Q/S262N/Y191D | 621 | Combination w/ PRB-ADA interaction |
| R222Q/S265N/F186K | R219Q/S262N/F183K | 622 | Combination w/ PRB-ADA interaction |
| R222Q/S265N/Y194D/Y227R | R219Q/S262N/Y191D/Y224R | 623 | Combination w/ PRB-ADA interaction |
| R222Q/S265N/F112S | R219Q/S262N/F109S | 624 | Combination w/ PRB-ADA interaction |
| R222Q/S265N/F112A | R219Q/S262N/F109A | 625 | Combination w/ PRB-ADA interaction |
| R222Q/S265N/R121D | R219Q/S262N/R118D | 626 | Combination w/ PRB-ADA interaction |
| R222Q/S265N/R121A | R219Q/S262N/R118A | 627 | Combination w/ PRB-ADA interaction |
| R222Q/S265N/Y142T | R219Q/S262N/Y139T | 628 | Combination w/ PRB-ADA interaction |
| R222Q/S265N/Y142A | R219Q/S262N/Y139A | 629 | Combination w/ PRB-ADA interaction |
| R222Q/S265N/W136S | R219Q/S262N/W133S | 630 | Combination w/ PRB-ADA interaction |
| R222Q/S265N/W136T | R219Q/S262N/W133T | 631 | Combination w/ PRB-ADA interaction |
| R222Q/S265N/P127A | R219Q/S262N/P124A | 632 | Combination w/ PRB-ADA interaction |
| R222Q/S265N/P127S | R219Q/S262N/P124S | 633 | Combination w/ PRB-ADA interaction |
| R222Q/S265N/V102-Q147del→(GGGGS)$_1$ | R219Q/S262N/V99-Q144del→(GGGGS)$_1$ | 634 | Combination w/ PRB deletion |
| R222Q/S265N/V102-Q147del→(GGGGS)$_2$ | R219Q/S262N/V99-Q144del→(GGGGS)$_2$ | 635 | Combination w/ PRB deletion |
| R222Q/S265N/V102-Q147del→(GGGGS)$_3$ | R219Q/S262N/V99-Q144del→(GGGGS)$_3$ | 636 | Combination w/ PRB deletion |
| R222Q/S265N/C108-T150del→(GGGGS)$_1$ | R219Q/S262N/C105-T147del→(GGGGS)$_1$ | 637 | Combination w/ PRB deletion |
| R222Q/S265N/C108-T150del→(GGGGS)$_2$ | R219Q/S262N/C105-T147del→(GGGGS)$_2$ | 638 | Combination w/ PRB deletion |
| R222Q/S265N/C108-T150del→(GGGGS)$_3$ | R219Q/S262N/C105-T147del→(GGGGS)$_3$ | 639 | Combination w/ PRB deletion |
| R222Q/S265N/K374D/V102-Q147del→(GGGGS)$_1$ | R219Q/S262N/K371D/V99-Q144del→(GGGGS)$_1$ | 640 | Combination w/ PRB deletion |
| R222Q/S265N/K374D/V102-Q147del→(GGGGS)$_2$ | R219Q/S262N/K371D/V99-Q144del→(GGGGS)$_2$ | 641 | Combination w/ PRB deletion |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/S265N/K374D/V102-Q147del→(GGGGS)$_3$ | R219Q/S262N/K371D/V99-Q144del→(GGGGS)$_3$ | 642 | Combination w/ PRB deletion |
| R222Q/S265N/K374D/C108-T150del→(GGGGS)$_1$ | R219Q/S262N/K371D/C105-T147del→(GGGGS)$_1$ | 643 | Combination w/ PRB deletion |
| R222Q/S265N/K374D/C108-T150del→(GGGGS)$_2$ | R219Q/S262N/K371D/C105-T147del→(GGGGS)$_2$ | 644 | Combination w/ PRB deletion |
| R222Q/S265N/K374D/C108-T150del→(GGGGS)$_3$ | R219Q/S262N/K371D/C105-T147del→(GGGGS)$_3$ | 645 | Combination w/ PRB deletion |
| K374D/C108-T150del→(Gly)n | K371D/C105-T147del→(Gly)n | 646 | Combination w/ PRB deletion |
| K374D/C108-T150del→(Gly)$_{15}$ | K371D/C105-T147del→(Gly)$_{15}$ | 647 | Combination w/ PRB deletion |
| K374D/C108-T150del→(Gly)$_{10}$ | K371D/C105-T147del→(Gly)$_{10}$ | 648 | Combination w/ PRB deletion |
| K374D/C108-T150del→(Gly)$_7$ | K371D/C105-T147del→(Gly)$_7$ | 649 | Combination w/ PRB deletion |
| K374D/C108-T150del→(Gly)$_5$ | K371D/C105-T147del→(Gly)$_5$ | 650 | Combination w/ PRB deletion |
| K374D/C108-T150del→(Gly)$_3$ | K371D/C105-T147del→(Gly)$_3$ | 651 | Combination w/ PRB deletion |
| K374D/V102-Q147del→(GGGGS)n | K371D/V99-Q144del→(GGGGS)n | 652 | Combination w/ PRB deletion |
| K374D/C108-T150del→(GGGGS)n | K371D/C105-T147del→(GGGGS)n | 653 | Combination w/ PRB deletion |
| K374D/N101-N159del | K371D/N98-N156del | 654 | Combination w/ PRB deletion |
| K374D/C108-E151del | K371D/C105-E148del | 655 | Combination w/ PRB deletion |
| K374D/C108-T150del | K371D/C105-T147del | 656 | Combination w/ PRB deletion |
| K374D/V102-Q147del | K371D/V99-Q144del | 657 | Combination w/ PRB deletion |
| R222Q/S265N/C108-T150del→(Gly)n | R219Q/S262N/C105-T147del→(Gly)n | 658 | Combination w/ PRB deletion |
| R222Q/S265N/K14A | R219Q/S262N/K11A | 659 | Combination |
| R222Q/S265N/K14D | R219Q/S262N/K11D | 660 | Combination |
| R222Q/S265N/K14E | R219Q/S262N/K11E | 661 | Combination |
| R222Q/S265N/K16A | R219Q/S262N/K13A | 662 | Combination |
| R222Q/S265N/K16D | R219Q/S262N/K13D | 663 | Combination |
| R222Q/S265N/V102-Q147del→(GGGGS)n | R219Q/S262N/V99-Q144del→(GGGGS)n | 664 | Combination w/ PRB deletion |
| R222Q/S265N/C108-T150del→(GGGGS)n | R219Q/S262N/C105-T147del→(GGGGS)n | 665 | Combination w/ PRB deletion |
| R222Q/S265N/N101-N159del | R219Q/S262N/N98-N156del | 666 | Combination w/ PRB deletion |
| R222Q/S265N/C108-E151del | R219Q/S262N/C105-E148del | 667 | Combination w/ PRB deletion |
| R222Q/S265N/C108-T150del | R219Q/S262N/C105-T147del | 668 | Combination w/ PRB deletion |
| R222Q/S265N/V102-Q147del | R219Q/S262N/V99-Q144del | 669 | Combination w/ PRB deletion |
| R222Q/S265N/K374D/C108-T150del→(Gly)n | R219Q/S262N/K371D/C105-T147del→(Gly)n | 670 | Combination w/ PRB deletion |
| R222Q/S265N/K374D/C108-T150del→(Gly)$_{15}$ | R219Q/S262N/K371D/C105-T147del→(Gly)$_{15}$ | 671 | Combination w/ PRB deletion |
| R222Q/S265N/K374D/C108-T150del→(Gly)$_{10}$ | R219Q/S262N/K371D/C105-T147del→(Gly)$_{10}$ | 672 | Combination w/ PRB deletion |
| R222Q/S265N/K374D/C108-T150del→(Gly)$_7$ | R219Q/S262N/K371D/C105-T147del→(Gly)$_7$ | 673 | Combination w/ PRB deletion |
| R222Q/S265N/K374D/C108-T150del→(Gly)$_5$ | R219Q/S262N/K371D/C105-T147del→(Gly)$_5$ | 674 | Combination w/ PRB deletion |
| R222Q/S265N/K374D/C108-T150del→(Gly)$_3$ | R219Q/S262N/K371D/C105-T147del→(Gly)$_3$ | 675 | Combination w/ PRB deletion |
| R222Q/S265N/K374D/V102-Q147del→(GGGGS)n | R219Q/S262N/K371D/V99-Q144del→(GGGGS)n | 676 | Combination w/ PRB deletion |
| R222Q/S265N/K374D/C108-T150del→(GGGGS)n | R219Q/S262N/K371D/C105-T147del→(GGGGS)n | 677 | Combination w/ PRB deletion |
| R222Q/S265N/K374D/N101-N159del | R219Q/S262N/K371D/N98-N156del | 678 | Combination w/ PRB deletion |
| R222Q/S265N/K374D/C108-E151del | R219Q/S262N/K371D/C105-E148del | 679 | Combination w/ PRB deletion |
| R222Q/S265N/K374D/C108-T150del | R219Q/S262N/K371D/C105-T147del | 680 | Combination w/ PRB deletion |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/S265N/K374D/V102-Q147del | R219Q/S262N/K371D/V99-Q144del | 681 | Combination w/ PRB deletion |
| R222Q/S265N/K16E | R219Q/S262N/K13E | 682 | Combination |
| R222Q/S265N/K374A | R219Q/S262N/K371A | 683 | Combination |
| R222Q/S265N/K375A | R219Q/S262N/K372A | 684 | Combination |
| R222Q/S265N/K375D | R219Q/S262N/K372D | 685 | Combination |
| R222Q/S265N/K375E | R219Q/S262N/K372E | 686 | Combination |
| R222Q/S265N/K455A | R219Q/S262N/K452A | 687 | Combination |
| R222Q/S265N/K455D | R219Q/S262N/K452D | 688 | Combination |
| R222Q/S265N/K455E | R219Q/S262N/K452E | 689 | Combination |
| R222Q/S265N/R23A | R219Q/S262N/R20A | 690 | Combination |
| R222Q/S265N/R23D | R219Q/S262N/R20D | 691 | Combination |
| R222Q/S265N/R369A | R219Q/S262N/R366A | 692 | Combination |
| R222Q/S265N/R369D | R219Q/S262N/R366D | 693 | Combination |
| R222Q/S265N/R369E | R219Q/S262N/R366E | 694 | Combination |
| R222Q/S265N/H267A | R219Q/S262N/H264A | 695 | Combination |
| R222Q/S265N/H267Q | R219Q/S262N/H264Q | 696 | Combination |
| R222Q/S265N/H267N | R219Q/S262N/H264N | 697 | Combination |
| R222Q/S265N/H267G | R219Q/S262N/H264G | 698 | Combination |
| R222K/S265N | R219K/S262N | 699 | Combination |
| R222N/S265N | R219N/S262N | 700 | Combination |
| R222A/S265N | R219A/S262N | 701 | Combination |
| R222Q/S265N/L224A | R219Q/S262N/L221A | 702 | Combination |
| R222Q/S265N/L224V | R219Q/S262N/L221V | 703 | Combination |
| R222Q/S265N/L224G | R219Q/S262N/L221G | 704 | Combination |
| R222Q/S265N/E182D | R219Q/S262N/E179D | 705 | Combination |
| R222Q/S265N/E182A | R219Q/S262N/E179A | 706 | Combination |
| R222Q/S265N/E182S | R219Q/S262N/E179S | 707 | Combination |
| R222Q/S265N/E182T | R219Q/S262N/E179T | 708 | Combination |
| R222Q/S265N/E182V | R219Q/S262N/E179V | 709 | Combination |
| R222Q/S265N/E182G | R219Q/S262N/E179G | 710 | Combination |
| R222Q/S265A | R219Q/S262A | 711 | Combination |
| R222Q/S265V | R219Q/S262V | 712 | Combination |
| R222Q/S265M | R219Q/S262M | 713 | Combination |
| R222Q/S265N/K14A/R23A | R219Q/S262N/K11A/R20A | 714 | Combination |
| R222Q/S265N/K14A/R23A/K374A | R219Q/S262N/K11A/R20A/K371A | 715 | Combination |
| R222Q/S265N/R23A/K374A | R219Q/S262N/R20A/K371A | 716 | Combination |
| R222Q/S265N/K14A/K374A | R219Q/S262N/K11A/K371A | 717 | Combination |
| R222Q/S265N/K29A | R219Q/S262N/K26A | 718 | Combination |
| R222Q/S265N/K29D | R219Q/S262N/K26D | 719 | Combination |
| R222Q/S265N/K29E | R219Q/S262N/K26E | 720 | Combination |
| R222Q/S265N/R220A | R219Q/S262N/R217A | 721 | Combination |
| R222Q/S265N/R220D | R219Q/S262N/R217D | 722 | Combination |
| R222Q/S265N/R220E | R219Q/S262N/R217E | 723 | Combination |
| R222Q/S265N/K261A | R219Q/S262N/K258A | 724 | Combination |
| R222Q/S265N/K261D | R219Q/S262N/K258D | 725 | Combination |
| R222Q/S265N/K261E | R219Q/S262N/K258E | 726 | Combination |
| R222Q/S265N/R280A | R219Q/S262N/R277A | 727 | Combination |
| R222Q/S265N/R280D | R219Q/S262N/R277D | 728 | Combination |
| R222Q/S265N/R280E | R219Q/S262N/R277E | 729 | Combination |
| R222Q/S265N/R286A | R219Q/S262N/R283A | 730 | Combination |
| R222Q/S265N/R286D | R219Q/S262N/R283D | 731 | Combination |
| R222Q/S265N/R286E | R219Q/S262N/R283E | 732 | Combination |
| R222Q/S265N/K312A | R219Q/S262N/K309A | 733 | Combination |
| R222Q/S265N/K312D | R219Q/S262N/K309D | 734 | Combination |
| R222Q/S265N/K312E | R219Q/S262N/K309E | 735 | Combination |
| R222Q/S265N/K320A | R219Q/S262N/K317A | 736 | Combination |
| R222Q/S265N/K320D | R219Q/S262N/K317D | 737 | Combination |
| R222Q/S265N/K320E | R219Q/S262N/K317E | 738 | Combination |
| R222Q/S265N/K324A | R219Q/S262N/K321A | 739 | Combination |
| R222Q/S265N/K324D | R219Q/S262N/K321D | 740 | Combination |
| R222Q/S265N/K324E | R219Q/S262N/K321E | 741 | Combination |
| R222Q/S265N/R355A | R219Q/S262N/R352A | 742 | Combination |
| R222Q/S265N/R355D | R219Q/S262N/R352D | 743 | Combination |
| R222Q/S265N/R355E | R219Q/S262N/R352E | 744 | Combination |
| R222Q/S265N/R444A | R219Q/S262N/R441A | 745 | Combination |
| R222Q/S265N/R444D | R219Q/S262N/R441D | 746 | Combination |
| R222Q/S265N/R444E | R219Q/S262N/R441E | 747 | Combination |
| R222Q/S265N/K447A | R219Q/S262N/K444A | 748 | Combination |
| R222Q/S265N/K447D | R219Q/S262N/K444D | 749 | Combination |
| R222Q/S265N/K447E | R219Q/S262N/K444E | 750 | Combination |
| R222Q/S265N/K464A | R219Q/S262N/K461A | 751 | Combination |
| R222Q/S265N/K464D | R219Q/S262N/K461D | 752 | Combination |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/S265N/K464E | R219Q/S262N/K461E | 753 | Combination |
| R222Q/S265N/K472A | R219Q/S262N/K469A | 754 | Combination |
| R222Q/S265N/K472D | R219Q/S262N/K469D | 755 | Combination |
| R222Q/S265N/K472E | R219Q/S262N/K469E | 756 | Combination |
| R222Q/S265N/K473A | R219Q/S262N/K470A | 757 | Combination |
| R222Q/S265N/K473D | R219Q/S262N/K470D | 758 | Combination |
| R222Q/S265N/K473E | R219Q/S262N/K470E | 759 | Combination |
| R222Q/S265N/D89A | R219Q/S262N/D86A | 760 | Combination |
| R222Q/S265N/D89C | R219Q/S262N/D86C | 761 | Combination |
| R222Q/S265N/D89E | R219Q/S262N/D86E | 762 | Combination |
| R222Q/S265N/D89F | R219Q/S262N/D86F | 763 | Combination |
| R222Q/S265N/D89G | R219Q/S262N/D86G | 764 | Combination |
| R222Q/S265N/D89H | R219Q/S262N/D86H | 765 | Combination |
| R222Q/S265N/D89I | R219Q/S262N/D86I | 766 | Combination |
| R222Q/S265N/D89K | R219Q/S262N/D86K | 767 | Combination |
| R222Q/S265N/D89L | R219Q/S262N/D86L | 768 | Combination |
| R222Q/S265N/D89M | R219Q/S262N/D86M | 769 | Combination |
| R222Q/S265N/D89N | R219Q/S262N/D86N | 770 | Combination |
| R222Q/S265N/D89P | R219Q/S262N/D86P | 771 | Combination |
| R222Q/S265N/D89Q | R219Q/S262N/D86Q | 772 | Combination |
| R222Q/S265N/D89R | R219Q/S262N/D86R | 773 | Combination |
| R222Q/S265N/D89S | R219Q/S262N/D86S | 774 | Combination |
| R222Q/S265N/D89T | R219Q/S262N/D86T | 775 | Combination |
| R222Q/S265N/D89V | R219Q/S262N/D86V | 776 | Combination |
| R222Q/S265N/D89W | R219Q/S262N/D86W | 777 | Combination |
| R222Q/S265N/D89Y | R219Q/S262N/D86Y | 778 | Combination |
| R222Q/S265N/E182C | R219Q/S262N/E179C | 779 | Combination |
| R222Q/S265N/E182F | R219Q/S262N/E179F | 780 | Combination |
| R222Q/S265N/E182H | R219Q/S262N/E179H | 781 | Combination |
| R222Q/S265N/E182I | R219Q/S262N/E179I | 782 | Combination |
| R222Q/S265N/E182K | R219Q/S262N/E179K | 783 | Combination |
| R222Q/S265N/E182L | R219Q/S262N/E179L | 784 | Combination |
| R222Q/S265N/E182M | R219Q/S262N/E179M | 785 | Combination |
| R222Q/S265N/E182N | R219Q/S262N/E179N | 786 | Combination |
| R222Q/S265N/E182P | R219Q/S262N/E179P | 787 | Combination |
| R222Q/S265N/E182Q | R219Q/S262N/E179Q | 788 | Combination |
| R222Q/S265N/E182R | R219Q/S262N/E179R | 789 | Combination |
| R222Q/S265N/E182W | R219Q/S262N/E179W | 790 | Combination |
| R222Q/S265N/E182Y | R219Q/S262N/E179Y | 791 | Combination |
| R222C/S265N | R219C/S262N | 792 | Combination |
| R222D/S265N | R219D/S262N | 793 | Combination |
| R222E/S265N | R219E/S262N | 794 | Combination |
| R222F/S265N | R219F/S262N | 795 | Combination |
| R222G/S265N | R219G/S262N | 796 | Combination |
| R222H/S265N | R219H/S262N | 797 | Combination |
| R222I/S265N | R219I/S262N | 798 | Combination |
| R222L/S265N | R219L/S262N | 799 | Combination |
| R222M/S265N | R219M/S262N | 800 | Combination |
| R222P/S265N | R219P/S262N | 801 | Combination |
| R222S/S265N | R219S/S262N | 802 | Combination |
| R222T/S265N | R219T/S262N | 803 | Combination |
| R222V/S265N | R219V/S262N | 804 | Combination |
| R222W/S265N | R219W/S262N | 805 | Combination |
| R222Y/S265N | R219Y/S262N | 806 | Combination |
| R222Q/S265N/L224C | R219Q/S262N/L221C | 807 | Combination |
| R222Q/S265N/L224D | R219Q/S262N/L221D | 808 | Combination |
| R222Q/S265N/L224E | R219Q/S262N/L221E | 809 | Combination |
| R222Q/S265N/L224F | R219Q/S262N/L221F | 810 | Combination |
| R222Q/S265N/L224H | R219Q/S262N/L221H | 811 | Combination |
| R222Q/S265N/L224I | R219Q/S262N/L221I | 812 | Combination |
| R222Q/S265N/L224K | R219Q/S262N/L221K | 813 | Combination |
| R222Q/S265N/L224M | R219Q/S262N/L221M | 814 | Combination |
| R222Q/S265N/L224N | R219Q/S262N/L221N | 815 | Combination |
| R222Q/S265N/L224P | R219Q/S262N/L221P | 816 | Combination |
| R222Q/S265N/L224Q | R219Q/S262N/L221Q | 817 | Combination |
| R222Q/S265N/L224R | R219Q/S262N/L221R | 818 | Combination |
| R222Q/S265N/L224S | R219Q/S262N/L221S | 819 | Combination |
| R222Q/S265N/L224T | R219Q/S262N/L221T | 820 | Combination |
| R222Q/S265N/L224W | R219Q/S262N/L221W | 821 | Combination |
| R222Q/S265N/L224Y | R219Q/S262N/L221Y | 822 | Combination |
| R222Q/S265C | R219Q/S262C | 823 | Combination |
| R222Q/S265D | R219Q/S262D | 824 | Combination |
| R222Q/S265E | R219Q/S262E | 825 | Combination |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/S265F | R219Q/S262F | 826 | Combination |
| R222Q/S265G | R219Q/S262G | 827 | Combination |
| R222Q/S265H | R219Q/S262H | 828 | Combination |
| R222Q/S265I | R219Q/S262I | 829 | Combination |
| R222Q/S265K | R219Q/S262K | 830 | Combination |
| R222Q/S265L | R219Q/S262L | 831 | Combination |
| R222Q/S265P | R219Q/S262P | 832 | Combination |
| R222Q/S265Q | R219Q/S262Q | 833 | Combination |
| R222Q/S265R | R219Q/S262R | 834 | Combination |
| R222Q/S265T | R219Q/S262T | 835 | Combination |
| R222Q/S265W | R219Q/S262W | 836 | Combination |
| R222Q/S265Y | R219Q/S262Y | 837 | Combination |
| R222Q/S265N/H267C | R219Q/S262N/H264C | 838 | Combination |
| R222Q/S265N/H267D | R219Q/S262N/H264D | 839 | Combination |
| R222Q/S265N/H267E | R219Q/S262N/H264E | 840 | Combination |
| R222Q/S265N/H267F | R219Q/S262N/H264F | 841 | Combination |
| R222Q/S265N/H267I | R219Q/S262N/H264I | 842 | Combination |
| R222Q/S265N/H267K | R219Q/S262N/H264K | 843 | Combination |
| R222Q/S265N/H267L | R219Q/S262N/H264L | 844 | Combination |
| R222Q/S265N/H267M | R219Q/S262N/H264M | 845 | Combination |
| R222Q/S265N/H267P | R219Q/S262N/H264P | 846 | Combination |
| R222Q/S265N/H267R | R219Q/S262N/H264R | 847 | Combination |
| R222Q/S265N/H267S | R219Q/S262N/H264S | 848 | Combination |
| R222Q/S265N/H267T | R219Q/S262N/H264T | 849 | Combination |
| R222Q/S265N/H267V | R219Q/S262N/H264V | 850 | Combination |
| R222Q/S265N/H267W | R219Q/S262N/H264W | 851 | Combination |
| R222Q/S265N/H267Y | R219Q/S262N/H264Y | 852 | Combination |
| R222Q/S265N/S269A | R219Q/S262N/S266A | 853 | Combination |
| R222Q/S265N/S269C | R219Q/S262N/S266C | 854 | Combination |
| R222Q/S265N/S269D | R219Q/S262N/S266D | 855 | Combination |
| R222Q/S265N/S269E | R219Q/S262N/S266E | 856 | Combination |
| R222Q/S265N/S269F | R219Q/S262N/S266F | 857 | Combination |
| R222Q/S265N/S269G | R219Q/S262N/S266G | 858 | Combination |
| R222Q/S265N/S269H | R219Q/S262N/S266H | 859 | Combination |
| R222Q/S265N/S269I | R219Q/S262N/S266I | 860 | Combination |
| R222Q/S265N/S269K | R219Q/S262N/S266K | 861 | Combination |
| R222Q/S265N/S269L | R219Q/S262N/S266L | 862 | Combination |
| R222Q/S265N/S269M | R219Q/S262N/S266M | 863 | Combination |
| R222Q/S265N/S269N | R219Q/S262N/S266N | 864 | Combination |
| R222Q/S265N/S269P | R219Q/S262N/S266P | 865 | Combination |
| R222Q/S265N/S269Q | R219Q/S262N/S266Q | 866 | Combination |
| R222Q/S265N/S269R | R219Q/S262N/S266R | 867 | Combination |
| R222Q/S265N/S269T | R219Q/S262N/S266T | 868 | Combination |
| R222Q/S265N/S269V | R219Q/S262N/S266V | 869 | Combination |
| R222Q/S265N/S269W | R219Q/S262N/S266W | 870 | Combination |
| R222Q/S265N/S269Y | R219Q/S262N/S266Y | 871 | Combination |
| R222Q/S265N/K270A | R219Q/S262N/K267A | 872 | Combination |
| R222Q/S265N/K270C | R219Q/S262N/K267C | 873 | Combination |
| R222Q/S265N/K270D | R219Q/S262N/K267D | 874 | Combination |
| R222Q/S265N/K270E | R219Q/S262N/K267E | 875 | Combination |
| R222Q/S265N/K270F | R219Q/S262N/K267F | 876 | Combination |
| R222Q/S265N/K270G | R219Q/S262N/K267G | 877 | Combination |
| R222Q/S265N/K270H | R219Q/S262N/K267H | 878 | Combination |
| R222Q/S265N/K270I | R219Q/S262N/K267I | 879 | Combination |
| R222Q/S265N/K270L | R219Q/S262N/K267L | 880 | Combination |
| R222Q/S265N/K270M | R219Q/S262N/K267M | 881 | Combination |
| R222Q/S265N/K270N | R219Q/S262N/K267N | 882 | Combination |
| R222Q/S265N/K270P | R219Q/S262N/K267P | 883 | Combination |
| R222Q/S265N/K270Q | R219Q/S262N/K267Q | 884 | Combination |
| R222Q/S265N/K270R | R219Q/S262N/K267R | 885 | Combination |
| R222Q/S265N/K270S | R219Q/S262N/K267S | 886 | Combination |
| R222Q/S265N/K270T | R219Q/S262N/K267T | 887 | Combination |
| R222Q/S265N/K270V | R219Q/S262N/K267V | 888 | Combination |
| R222Q/S265N/K270W | R219Q/S262N/K267W | 889 | Combination |
| R222Q/S265N/K270Y | R219Q/S262N/K267Y | 890 | Combination |
| R222Q/S265N/V299A | R219Q/S262N/V296A | 891 | Combination |
| R222Q/S265N/V299C | R219Q/S262N/V296C | 892 | Combination |
| R222Q/S265N/V299D | R219Q/S262N/V296D | 893 | Combination |
| R222Q/S265N/V299E | R219Q/S262N/V296E | 894 | Combination |
| R222Q/S265N/V299F | R219Q/S262N/V296F | 895 | Combination |
| R222Q/S265N/V299G | R219Q/S262N/V296G | 896 | Combination |
| R222Q/S265N/V299H | R219Q/S262N/V296H | 897 | Combination |
| R222Q/S265N/V299I | R219Q/S262N/V296I | 898 | Combination |

TABLE 55-continued

Variant ADA2 polypeptides comprising the listed mutations

| Zavialov numbering (SEQ ID NO: 4) | Mature numbering (SEQ ID NO: 5) | SEQ ID NO. of an exemplary polypeptides | Type |
|---|---|---|---|
| R222Q/S265N/V299K | R219Q/S262N/V296K | 899 | Combination |
| R222Q/S265N/V299L | R219Q/S262N/V296L | 900 | Combination |
| R222Q/S265N/V299M | R219Q/S262N/V296M | 901 | Combination |
| R222Q/S265N/V299N | R219Q/S262N/V296N | 902 | Combination |
| R222Q/S265N/V299P | R219Q/S262N/V296P | 903 | Combination |
| R222Q/S265N/V299Q | R219Q/S262N/V296Q | 904 | Combination |
| R222Q/S265N/V299R | R219Q/S262N/V296R | 905 | Combination |
| R222Q/S265N/V299S | R219Q/S262N/V296S | 906 | Combination |
| R222Q/S265N/V299T | R219Q/S262N/V296T | 907 | Combination |
| R222Q/S265N/V299W | R219Q/S262N/V296W | 908 | Combination |
| R222Q/S265N/V299Y | R219Q/S262N/V296Y | 909 | Combination |
| R222Q/K14A/R23A | R219Q/K11A/R20A | 910 | Combination |
| R222Q/K14A/R23A/K374A | R219Q/K11A/R20A/K371A | 911 | Combination |
| R222Q/R23A/K374A | R219Q/R20A/K371A | 912 | Combination |
| R222Q/K14A/K374A | R219Q/K11A/K371A | 913 | Combination |
| S265N/K14A/R23A | S262N/K11A/R20A | 914 | Combination |
| S265N/K14A/R23A/K374A | S262N/K11A/R20A/K371A | 915 | Combination |
| S265N/R23A/K374A | S262N/R20A/K371A | 916 | Combination |
| S265N/K14A/K374A | S262N/K11A/K371A | 917 | Combination |
| R222Q/C108-T150del→(Gly)n | R219Q/C105-T147del→(Gly)n | 918 | Combination w/ PRB deletion |
| R222Q/V102-Q147del→(GGGGS)n | R219Q/V99-Q144del→(GGGGS)n | 919 | Combination w/ PRB deletion |
| R222Q/C108-T150del→(GGGGS)n | R219Q/C105-T147del→(GGGGS)n | 920 | Combination w/ PRB deletion |
| R222Q/N101-N159del | R219Q/N98-N156del | 921 | Combination w/ PRB deletion |
| R222Q/C108-E151del | R219Q/C105-E148del | 922 | Combination w/ PRB deletion |
| R222Q/C108-T150del | R219Q/C105-T147del | 923 | Combination w/ PRB deletion |
| R222Q/V102-Q147del | R219Q/V99-Q144del | 924 | Combination w/ PRB deletion |
| S265N/C108-T150del→(Gly)n | S262N/C105-T147del→(Gly)n | 925 | Combination w/ PRB deletion |
| S265N/V102-Q147del→(GGGGS)n | S262N/V99-Q144del→(GGGGS)n | 926 | Combination w/ PRB deletion |
| S265N/C108-T150del→(GGGGS)n | S262N/C105-T147del→(GGGGS)n | 927 | Combination w/ PRB deletion |
| S265N/N101-N159del | S262N/N98-N156del | 928 | Combination w/ PRB deletion |
| S265N/C108-E151del | S262N/C105-E148del | 929 | Combination w/ PRB deletion |
| S265N/C108-T150del | S262N/C105-T147del | 930 | Combination w/ PRB deletion |
| S265N/V102-Q147del | S262N/V99-Q144del | 931 | Combination w/ PRB deletion |

Since modifications will be apparent to those of skill in the art, it is intended that this invention be limited only by the scope of the appended claims.

SEQUENCE LISTING (931 sequences)

SEQ ID NO: 1 - DNA, 1533 bp, Homo sapiens
  Adenosine deaminase 2 precursor
atgttggtggatggcccatctgagcggccagccctgtgcttcttgctgttggctgtggcaatgtctttcttcggctcagctctatccatagatgaaacacgggcgcatctgttgttgaaagaaaagatgatgcggctcggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctacgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaag

SEQ ID NO: 2 - protein, 511 aa, Homo sapiens
  Adenosine deaminase 2 precursor
  SIGNAL (1)...(29)
  ref <308>: DATABASE ACCESSION NUMBER: Uniprot Q9NZK5
  ref <309>: DATABASE ENTRY DATE: 2002-04-16
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 3 - protein, 376 aa, Artificial Sequence
  ADA1-linker-Strep
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNLSGSGSWSHPQFEK

SEQ ID NO: 4 - protein, 508 aa, Artificial Sequence
  ADA2 crystal structure sequence
GGSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATKGSLHHILDAQKMVWNHRHHHHHH

SEQ ID NO: 5 - protein, 482 aa, Homo sapiens
  ADA2 mature protein
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 6 - DNA, 4278 bp, Artificial Sequence
  pCMV-Script
atgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgattacgccaagctcgaaattaaccctcactaaagggaacaaaagctggagctccaccgcggtggcggccgctctagcccgggcggatcccccgggctgcaggaattcgatatcaagcttatcgataccgtcgacctcgagggggggcccggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagaatcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagaacatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagaacttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcc

SEQ ID NO: 7 - protein, 490 aa, Artificial Sequence
  ADA2-FLAG
  PEPTIDE (483)...(490): FLAG tag
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATKDYKDDDDK

SEQ ID NO: 8 - DNA, 24 bp, Artificial Sequence
  FLAG DNA
gattacaaggatgacgacgataag

SEQ ID NO: 9 - protein, 8 aa, Artificial Sequence
  FLAG tag
DYKDDDDK

SEQ ID NO: 10 - DNA, 10837 bp, Artificial Sequence
  pLV-EF1a-hADA2-Flag-IRES-GFP-Bsd plasmid
aagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgatgcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgatatcctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctctagataatacgactcactatagggcccgggttggatccgccaccatgttggtggatggcccatctgagcggccagccctgtgcttcttgctgttggctgtggcaatgtctttcttcggctcagctctatccatagatgaaacacgggcgcatctgttgttgaaagaaaagatgatgcggctcggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctacgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaaggattacaaggatgacgacgataagtgagctagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacactagagatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaaggacccaccggtcgccaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgc

SEQ ID NO: 11 - DNA, 1566 bp, Homo sapiens
  ADA1
  ref <308>: DATABASE ACCESSION NUMBER: NCBI  NM_000022.2
  ref <309>: DATABASE ENTRY DATE: 2014-05-03
ggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcaaaaaaaaaaaaaaaaaaaaaaaaaaaaaaaaaaa

SEQ ID NO: 12 - protein, 363 aa, Homo sapiens
  ADA1 protein
  ref <308>: DATABASE ACCESSION NUMBER: NCBI  NP_000013.2
  ref <309>: DATABASE ENTRY DATE: 2014-05-03
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 13 - protein, 482 aa, Artificial Sequence
  human ADA2 K11A, mature numbering
IDETRAHLLLAEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 14 - protein, 482 aa, Artificial Sequence
  human ADA2 K11D, mature numbering
IDETRAHLLLDEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 15 - protein, 482 aa, Artificial Sequence
  human ADA2 K11E, mature numbering
IDETRAHLLLEEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 16 - protein, 482 aa, Artificial Sequence
  human ADA2 K13A, mature numbering
IDETRAHLLLKEAMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 17 - protein, 482 aa, Artificial Sequence
  human ADA2 K13D, mature numbering
IDETRAHLLLKEDMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 18 - protein, 482 aa, Artificial Sequence
  human ADA2 K13E, mature numbering
IDETRAHLLLKEEMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 19 - protein, 482 aa, Artificial Sequence
  human ADA2 K371A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 20 - protein, 482 aa, Artificial Sequence
  human ADA2 K371D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 21 - protein, 482 aa, Artificial Sequence
  human ADA2 K371E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 22 - protein, 482 aa, Artificial Sequence
  human ADA2 K372A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKADIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 23 - protein, 482 aa, Artificial Sequence
  human ADA2 K372D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKDDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 24 - protein, 482 aa, Artificial Sequence
  human ADA2 K372E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKEDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 25 - protein, 482 aa, Artificial Sequence
  human ADA2 K452A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIAYSTLLESEKNTFMEIWKKRWDKFIADVATK

SEQ ID NO: 26 - protein, 482 aa, Artificial Sequence
  human ADA2 K452D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIDYSTLLESEKNTFMEIWKKRWDKFIADVATK

SEQ ID NO: 27 - protein, 482 aa, Artificial Sequence
  human ADA2 K452E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIEYSTLLESEKNTFMEIWKKRWDKFIADVATK

SEQ ID NO: 28 - protein, 482 aa, Artificial Sequence
  human ADA2 R20A, mature numbering
IDETRAHLLLKEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 29 - protein, 482 aa, Artificial Sequence
  human ADA2 R20D, mature numbering
IDETRAHLLLKEKMMRLGGDLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 30 - protein, 482 aa, Artificial Sequence
  human ADA2 R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 31 - protein, 482 aa, Artificial Sequence
  human ADA2 R366A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVATYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 32 - protein, 482 aa, Artificial Sequence
  human ADA2 R366D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVDTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 33 - protein, 482 aa, Artificial Sequence
  human ADA2 R366E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVETYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 34 - protein, 482 aa, Artificial Sequence
  human ADA2 H264A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDARSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 35 - protein, 482 aa, Artificial Sequence
  human ADA2 H264Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDQRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 36 - protein, 482 aa, Artificial Sequence
  human ADA2 H264N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDNRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 37 - protein, 482 aa, Artificial Sequence
  human ADA2 H264G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDGRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 38 - protein, 482 aa, Artificial Sequence
  human ADA2 R219K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAKLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 39 - protein, 482 aa, Artificial Sequence
  human ADA2 R219Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 40 - protein, 482 aa, Artificial Sequence
  human ADA2 R219N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRANLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 41 - protein, 482 aa, Artificial Sequence
  human ADA2 R219A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAALLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 42 - protein, 482 aa, Artificial Sequence
  human ADA2 L221A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLAPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 43 - protein, 482 aa, Artificial Sequence
  human ADA2 L221V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLVPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 44 - protein, 482 aa, Artificial Sequence
  human ADA2 L221G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLGPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 45 - protein, 482 aa, Artificial Sequence
  human ADA2 E179D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFDTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 46 - protein, 482 aa, Artificial Sequence
  human ADA2 E179A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFATIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 47 - protein, 482 aa, Artificial Sequence
  human ADA2 E179S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFSTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 48 - protein, 482 aa, Artificial Sequence
  human ADA2 E179T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFTTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 49 - protein, 482 aa, Artificial Sequence
  human ADA2 E179V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFVTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 50 - protein, 482 aa, Artificial Sequence
  human ADA2 E179G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFGTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 51 - protein, 482 aa, Artificial Sequence
  human ADA2 S262A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYADHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 52 - protein, 482 aa, Artificial Sequence
  human ADA2 S262V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYVDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 53 - protein, 482 aa, Artificial Sequence
  human ADA2 S262M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYMDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 54 - protein, 482 aa, Artificial Sequence
  human ADA2 S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 55 - protein, 482 aa, Artificial Sequence
  human ADA2 K11A/R20A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 56 - protein, 482 aa, Artificial Sequence
  human ADA2 K11A/R20A/K371A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 57 - protein, 482 aa, Artificial Sequence
  human ADA2 R20A/K371A, mature numbering
IDETRAHLLLKEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 58 - protein, 482 aa, Artificial Sequence
  human ADA2 K11A/K371A, mature numbering
IDETRAHLLLAEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 59 - protein, 482 aa, Artificial Sequence
  human ADA2 S262N/K371D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 60 - protein, 482 aa, Artificial Sequence
  human ADA2 S262N/K371E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 61 - protein, 482 aa, Artificial Sequence
  human ADA2 S262N/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 62 - protein, 482 aa, Artificial Sequence
  human ADA2 S262N/R20E/K371D, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 63 - protein, 482 aa, Artificial Sequence
  human ADA2 S262N/R20E/K371E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 64 - protein, 5 aa, Artificial Sequence
  SGSGS Linker
SGSGS

SEQ ID NO: 65 - protein, 8 aa, Artificial Sequence
  Strep tag
WSHPQFEK

SEQ ID NO: 66 - protein, 362 aa, Homo sapiens
  mature ADA1 protein
AQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 67 - protein, 375 aa, Artificial Sequence
  mature ADA1-linker-Strep
AQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNLSGSGSWSHPQFEK

SEQ ID NO: 68 - protein, 270 aa, Artificial Sequence
  ADA2 protein isoform 2
  ref <308>: DATABASE ACCESSION NUMBER: Uniprot Q9NZK5-2
  ref <309>: DATABASE ENTRY DATE: 2002-04-16
MDSLEWNWALVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 69 - protein, 362 aa, Artificial Sequence
  mature ADA1 C74S
AQTPAFDKPKVELHVHLDGSIKPETILYYGRRRGIALPANTAEGLLNVIGMDKPLTLPDFLAKFDYYMPAIAGSREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 70 - protein, 375 aa, Artificial Sequence
  mature ADA1-linker-Strep
AQTPAFDKPKVELHVHLDGSIKPETILYYGRRRGIALPANTAEGLLNVIGMDKPLTLPDFLAKFDYYMPAIAGSREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNLSGSGSWSHPQFEK

SEQ ID NO: 71 - protein, 482 aa, Artificial Sequence
  human ADA2 K26A, mature numbering
IDETRAHLLLKEKMMRLGGRLVLNTAEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 72 - protein, 482 aa, Artificial Sequence
  human ADA2 K26D, mature numbering
IDETRAHLLLKEKMMRLGGRLVLNTDEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 73 - protein, 482 aa, Artificial Sequence
  human ADA2 K26E, mature numbering
IDETRAHLLLKEKMMRLGGRLVLNTEEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 74 - protein, 482 aa, Artificial Sequence
  human ADA2 R217A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIAARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 75 - protein, 482 aa, Artificial Sequence
  human ADA2 R217D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIDARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 76 - protein, 482 aa, Artificial Sequence
  human ADA2 R217E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIEARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 77 - protein, 482 aa, Artificial Sequence
  human ADA2 K258A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIAIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 78 - protein, 482 aa, Artificial Sequence
  human ADA2 K258D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIDIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 79 - protein, 482 aa, Artificial Sequence
  human ADA2 K258E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIEIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 80 - protein, 482 aa, Artificial Sequence
  human ADA2 R277A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIAMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 81 - protein, 482 aa, Artificial Sequence
  human ADA2 R277D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIDMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 82 - protein, 482 aa, Artificial Sequence
  human ADA2 R277E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIEMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 83 - protein, 482 aa, Artificial Sequence
  human ADA2 R283A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLAIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 84 - protein, 482 aa, Artificial Sequence
  human ADA2 R283D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLDIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 85 - protein, 482 aa, Artificial Sequence
  human ADA2 R283E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLEIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 86 - protein, 482 aa, Artificial Sequence
  human ADA2 K309A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYAEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 87 - protein, 482 aa, Artificial Sequence
  human ADA2 K309D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYDEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 88 - protein, 482 aa, Artificial Sequence
  human ADA2 K309E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYEEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 89 - protein, 482 aa, Artificial Sequence
  human ADA2 K317A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAADGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 90 - protein, 482 aa, Artificial Sequence
  human ADA2 K317D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPADDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 91 - protein, 482 aa, Artificial Sequence
  human ADA2 K317E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAEDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 92 - protein, 482 aa, Artificial Sequence
  human ADA2 K321A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVALPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 93 - protein, 482 aa, Artificial Sequence
  human ADA2 K321D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVDLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 94 - protein, 482 aa, Artificial Sequence
  human ADA2 K321E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVELPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 95 - protein, 482 aa, Artificial Sequence
  human ADA2 R352A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTAIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 96 - protein, 482 aa, Artificial Sequence
  human ADA2 R352D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTDIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 97 - protein, 482 aa, Artificial Sequence
  human ADA2 R352E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTEIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 98 - protein, 482 aa, Artificial Sequence
  human ADA2 R441A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLATLKQLAMNSIKYSTLLESEKNTFMEIWKKRWDKFIADVATK

SEQ ID NO: 99 - protein, 482 aa, Artificial Sequence
  human ADA2 R441D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLDTLKQLAMNSIKYSTLLESEKNTFMEIWKKRWDKFIADVATK

SEQ ID NO: 100 - protein, 482 aa, Artificial Sequence
  human ADA2 R441E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLETLKQLAMNSIKYSTLLESEKNTFMEIWKKRWDKFIADVATK

SEQ ID NO: 101 - protein, 482 aa, Artificial Sequence
  human ADA2 K444A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLAQLAMNSIKYSTLLESEKNTFMEIWKKRWDKFIADVATK

SEQ ID NO: 102 - protein, 482 aa, Artificial Sequence
  human ADA2 K444D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLDQLAMNSIKYSTLLESEKNTFMEIWKKRWDKFIADVATK

SEQ ID NO: 103 - protein, 482 aa, Artificial Sequence
  human ADA2 K444E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLEQLAMNSIKYSTLLESEKNTFMEIWKKRWDKFIADVATK

SEQ ID NO: 104 - protein, 482 aa, Artificial Sequence
  human ADA2 K461A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEANTFMEIWKKRWDKFIADVATK

SEQ ID NO: 105 - protein, 482 aa, Artificial Sequence
  human ADA2 K461D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEDNTFMEIWKKRWDKFIADVATK

SEQ ID NO: 106 - protein, 482 aa, Artificial Sequence
  human ADA2 K461E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEENTFMEIWKKRWDKFIADVATK

SEQ ID NO: 107 - protein, 482 aa, Artificial Sequence
  human ADA2 K469A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWAKRWDKFIADVATK

SEQ ID NO: 108 - protein, 482 aa, Artificial Sequence
  human ADA2 K469D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWDKRWDKFIADVATK

SEQ ID NO: 109 - protein, 482 aa, Artificial Sequence
  human ADA2 K469E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWEKRWDKFIADVATK

SEQ ID NO: 110 - protein, 482 aa, Artificial Sequence
  human ADA2 K470A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKARWDKFIADVATK

SEQ ID NO: 111 - protein, 482 aa, Artificial Sequence
  human ADA2 K470D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKDRWDKFIADVATK

SEQ ID NO: 112 - protein, 482 aa, Artificial Sequence
  human ADA2 K470E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKERWDKFIADVATK

SEQ ID NO: 113 - protein, 482 aa, Artificial Sequence
  human ADA2 D86A, mature numbering
IDETRAHLLLKEKMMRLGGRLVLNTKEELANERLMTLKIAEMKEAMRTLIFPPSMHFFQAKHLIERSQVFNILRMMPKGAALHLHAIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 114 - protein, 482 aa, Artificial Sequence
  human ADA2 D86C, mature numbering
IDETRAHLLLKEKMMRLGGRLVLNTKEELANERLMTLKIAEMKEAMRTLIFPPSMHFFQAKHLIERSQVFNILRMMPKGAALHLHCIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 115 - protein, 482 aa, Artificial Sequence
  human ADA2 D86E, mature numbering
IDETRAHLLLKEKMMRLGGRLVLNTKEELANERLMTLKIAEMKEAMRTLIFPPSMHFFQAKHLIERSQVFNILRMMPKGAALHLHEIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 116 - protein, 482 aa, Artificial Sequence
  human ADA2 D86F, mature numbering
IDETRAHLLLKEKMMRLGGRLVLNTKEELANERLMTLKIAEMKEAMRTLIFPPSMHFFQAKHLIERSQVFNILRMMPKGAALHLHFIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 117 - protein, 482 aa, Artificial Sequence
  human ADA2 D86G, mature numbering
IDETRAHLLLKEKMMRLGGRLVLNTKEELANERLMTLKIAEMKEAMRTLIFPPSMHFFQAKHLIERSQVFNILRMMPKGAALHLHGIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 118 - protein, 482 aa, Artificial Sequence
  human ADA2 D86H, mature numbering
IDETRAHLLLKEKMMRLGGRLVLNTKEELANERLMTLKIAEMKEAMRTLIFPPSMHFFQAKHLIERSQVFNILRMMPKGAALHLHHIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 119 - protein, 482 aa, Artificial Sequence
  human ADA2 D86I, mature numbering
IDETRAHLLLKEKMMRLGGRLVLNTKEELANERLMTLKIAEMKEAMRTLIFPPSMHFFQAKHLIERSQVFNILRMMPKGAALHLHIIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 120 - protein, 482 aa, Artificial Sequence
  human ADA2 D86K, mature numbering
IDETRAHLLLKEKMMRLGGRLVLNTKEELANERLMTLKIAEMKEAMRTLIFPPSMHFFQAKHLIERSQVFNILRMMPKGAALHLHKIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 121 - protein, 482 aa, Artificial Sequence
  human ADA2 D86L, mature numbering
IDETRAHLLLKEKMMRLGGRLVLNTKEELANERLMTLKIAEMKEAMRTLIFPPSMHFFQAKHLIERSQVFNILRMMPKGAALHLHLIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 122 - protein, 482 aa, Artificial Sequence
  human ADA2 D86M, mature numbering
IDETRAHLLLKEKMMRLGGRLVLNTKEELANERLMTLKIAEMKEAMRTLIFPPSMHFFQAKHLIERSQVFNILRMMPKGAALHLHMIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 123 - protein, 482 aa, Artificial Sequence
  human ADA2 D86N, mature numbering
IDETRAHLLLKEKMMRLGGRLVLNTKEELANERLMTLKIAEMKEAMRTLIFPPSMHFFQAKHLIERSQVFNILRMMPKGAALHLHNIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 124 - protein, 482 aa, Artificial Sequence
  human ADA2 D86P, mature numbering
IDETRAHLLLKEKMMRLGGRLVLNTKEELANERLMTLKIAEMKEAMRTLIFPPSMHFFQAKHLIERSQVFNILRMMPKGAALHLHPIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 125 - protein, 482 aa, Artificial Sequence
  human ADA2 D86Q, mature numbering
IDETRAHLLLKEKMMRLGGRLVLNTKEELANERLMTLKIAEMKEAMRTLIFPPSMHFFQAKHLIERSQVFNILRMMPKGAALHLHQIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 126 - protein, 482 aa, Artificial Sequence
  human ADA2 D86R, mature numbering
IDETRAHLLLKEKMMRLGGRLVLNTKEELANERLMTLKIAEMKEAMRTLIFPPSMHFFQAKHLIERSQVFNILRMMPKGAALHLHRIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 127 - protein, 482 aa, Artificial Sequence
  human ADA2 D86S, mature numbering
IDETRAHLLLKEKMMRLGGRLVLNTKEELANERLMTLKIAEMKEAMRTLIFPPSMHFFQAKHLIERSQVFNILRMMPKGAALHLHSIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 128 - protein, 482 aa, Artificial Sequence
  human ADA2 D86T, mature numbering
IDETRAHLLLKEKMMRLGGRLVLNTKEELANERLMTLKIAEMKEAMRTLIFPPSMHFFQAKHLIERSQVFNILRMMPKGAALHLHTIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 129 - protein, 482 aa, Artificial Sequence
  human ADA2 D86V, mature numbering
IDETRAHLLLKEKMMRLGGRLVLNTKEELANERLMTLKIAEMKEAMRTLIFPPSMHFFQAKHLIERSQVFNILRMMPKGAALHLHVIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 130 - protein, 482 aa, Artificial Sequence
  human ADA2 D86W, mature numbering
IDETRAHLLLKEKMMRLGGRLVLNTKEELANERLMTLKIAEMKEAMRTLIFPPSMHFFQAKHLIERSQVFNILRMMPKGAALHLHWIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 131 - protein, 482 aa, Artificial Sequence
  human ADA2 D86Y, mature numbering
IDETRAHLLLKEKMMRLGGRLVLNTKEELANERLMTLKIAEMKEAMRTLIFPPSMHFFQAKHLIERSQVFNILRMMPKGAALHLHYIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 132 - protein, 482 aa, Artificial Sequence
  human ADA2 E179C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFCTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 133 - protein, 482 aa, Artificial Sequence
  human ADA2 E179F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFFTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 134 - protein, 482 aa, Artificial Sequence
  human ADA2 E179H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFHTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 135 - protein, 482 aa, Artificial Sequence
  human ADA2 E179I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFITIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 136 - protein, 482 aa, Artificial Sequence
  human ADA2 E179K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFKTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 137 - protein, 482 aa, Artificial Sequence
  human ADA2 E179L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFLTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 138 - protein, 482 aa, Artificial Sequence
  human ADA2 E179M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFMTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 139 - protein, 482 aa, Artificial Sequence
  human ADA2 E179N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFNTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 140 - protein, 482 aa, Artificial Sequence
  human ADA2 E179P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFPTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 141 - protein, 482 aa, Artificial Sequence
  human ADA2 E179Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFQTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 142 - protein, 482 aa, Artificial Sequence
  human ADA2 E179R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFRTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 143 - protein, 482 aa, Artificial Sequence
  human ADA2 E179W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFWTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 144 - protein, 482 aa, Artificial Sequence
  human ADA2 E179Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFYTIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 145 - protein, 482 aa, Artificial Sequence
  human ADA2 R219C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRACLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 146 - protein, 482 aa, Artificial Sequence
  human ADA2 R219D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRADLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 147 - protein, 482 aa, Artificial Sequence
  human ADA2 R219E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAELLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 148 - protein, 482 aa, Artificial Sequence
  human ADA2 R219F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAFLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 149 - protein, 482 aa, Artificial Sequence
  human ADA2 R219G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAGLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 150 - protein, 482 aa, Artificial Sequence
  human ADA2 R219H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAHLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 151 - protein, 482 aa, Artificial Sequence
  human ADA2 R219I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAILLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 152 - protein, 482 aa, Artificial Sequence
  human ADA2 R219L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRALLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 153 - protein, 482 aa, Artificial Sequence
  human ADA2 R219M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAMLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 154 - protein, 482 aa, Artificial Sequence
  human ADA2 R219P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAPLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 155 - protein, 482 aa, Artificial Sequence
  human ADA2 R219S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRASLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 156 - protein, 482 aa, Artificial Sequence
  human ADA2 R219T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRATLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 157 - protein, 482 aa, Artificial Sequence
  human ADA2 R219V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAVLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 158 - protein, 482 aa, Artificial Sequence
  human ADA2 R219W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAWLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 159 - protein, 482 aa, Artificial Sequence
  human ADA2 R219Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAYLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 160 - protein, 482 aa, Artificial Sequence
  human ADA2 L221C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLCPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 161 - protein, 482 aa, Artificial Sequence
  human ADA2 L221D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLDPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 162 - protein, 482 aa, Artificial Sequence
  human ADA2 L221E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLEPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 163 - protein, 482 aa, Artificial Sequence
  human ADA2 L221F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLFPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 164 - protein, 482 aa, Artificial Sequence
  human ADA2 L221H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLHPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 165 - protein, 482 aa, Artificial Sequence
  human ADA2 L221I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLIPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 166 - protein, 482 aa, Artificial Sequence
  human ADA2 L221K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLKPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 167 - protein, 482 aa, Artificial Sequence
  human ADA2 L221M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLMPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 168 - protein, 482 aa, Artificial Sequence
  human ADA2 L221N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLNPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 169 - protein, 482 aa, Artificial Sequence
  human ADA2 L221P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLPPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 170 - protein, 482 aa, Artificial Sequence
  human ADA2 L221Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLQPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 171 - protein, 482 aa, Artificial Sequence
  human ADA2 L221R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLRPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 172 - protein, 482 aa, Artificial Sequence
  human ADA2 L221S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLSPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 173 - protein, 482 aa, Artificial Sequence
  human ADA2 L221T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLTPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 174 - protein, 482 aa, Artificial Sequence
  human ADA2 L221W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLWPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 175 - protein, 482 aa, Artificial Sequence
  human ADA2 L221Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLYPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 176 - protein, 482 aa, Artificial Sequence
  human ADA2 S262C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYCDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 177 - protein, 482 aa, Artificial Sequence
  human ADA2 S262D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYDDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 178 - protein, 482 aa, Artificial Sequence
  human ADA2 S262E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYEDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 179 - protein, 482 aa, Artificial Sequence
  human ADA2 S262F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYFDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 180 - protein, 482 aa, Artificial Sequence
  human ADA2 S262G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYGDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 181 - protein, 482 aa, Artificial Sequence
  human ADA2 S262H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYHDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 182 - protein, 482 aa, Artificial Sequence
  human ADA2 S262I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYIDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 183 - protein, 482 aa, Artificial Sequence
  human ADA2 S262K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYKDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 184 - protein, 482 aa, Artificial Sequence
  human ADA2 S262L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYLDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 185 - protein, 482 aa, Artificial Sequence
  human ADA2 S262P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYPDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 186 - protein, 482 aa, Artificial Sequence
  human ADA2 S262Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYQDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 187 - protein, 482 aa, Artificial Sequence
  human ADA2 S262R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYRDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 188 - protein, 482 aa, Artificial Sequence
  human ADA2 S262T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYTDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 189 - protein, 482 aa, Artificial Sequence
  human ADA2 S262W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYWDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 190 - protein, 482 aa, Artificial Sequence
  human ADA2 S262Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYYDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 191 - protein, 482 aa, Artificial Sequence
  human ADA2 H264C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDCRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 192 - protein, 482 aa, Artificial Sequence
  human ADA2 H264D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDDRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 193 - protein, 482 aa, Artificial Sequence
  human ADA2 H264E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDERSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 194 - protein, 482 aa, Artificial Sequence
  human ADA2 H264F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDFRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 195 - protein, 482 aa, Artificial Sequence
  human ADA2 H264I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDIRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 196 - protein, 482 aa, Artificial Sequence
  human ADA2 H264K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDKRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 197 - protein, 482 aa, Artificial Sequence
  human ADA2 H264L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDLRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 198 - protein, 482 aa, Artificial Sequence
  human ADA2 H264M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDMRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 199 - protein, 482 aa, Artificial Sequence
  human ADA2 H264P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDPRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 200 - protein, 482 aa, Artificial Sequence
  human ADA2 H264R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDRRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 201 - protein, 482 aa, Artificial Sequence
  human ADA2 H264S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDSRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 202 - protein, 482 aa, Artificial Sequence
  human ADA2 H264T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDTRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 203 - protein, 482 aa, Artificial Sequence
  human ADA2 H264V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDVRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 204 - protein, 482 aa, Artificial Sequence
  human ADA2 H264W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDWRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 205 - protein, 482 aa, Artificial Sequence
  human ADA2 H264Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDYRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 206 - protein, 482 aa, Artificial Sequence
  human ADA2 S266A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRAKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 207 - protein, 482 aa, Artificial Sequence
  human ADA2 S266C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRCKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 208 - protein, 482 aa, Artificial Sequence
  human ADA2 S266D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRDKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 209 - protein, 482 aa, Artificial Sequence
  human ADA2 S266E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHREKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 210 - protein, 482 aa, Artificial Sequence
  human ADA2 S266F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRFKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 211 - protein, 482 aa, Artificial Sequence
  human ADA2 S266G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRGKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 212 - protein, 482 aa, Artificial Sequence
  human ADA2 S266H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRHKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 213 - protein, 482 aa, Artificial Sequence
  human ADA2 S266I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRIKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 214 - protein, 482 aa, Artificial Sequence
  human ADA2 S266K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRKKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 215 - protein, 482 aa, Artificial Sequence
  human ADA2 S266L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRLKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 216 - protein, 482 aa, Artificial Sequence
  human ADA2 S266M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRMKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 217 - protein, 482 aa, Artificial Sequence
  human ADA2 S266N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRNKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 218 - protein, 482 aa, Artificial Sequence
  human ADA2 S266P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRPKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 219 - protein, 482 aa, Artificial Sequence
  human ADA2 S266Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRQKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 220 - protein, 482 aa, Artificial Sequence
  human ADA2 S266R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRRKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 221 - protein, 482 aa, Artificial Sequence
  human ADA2 S266T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRTKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 222 - protein, 482 aa, Artificial Sequence
  human ADA2 S266V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRVKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 223 - protein, 482 aa, Artificial Sequence
  human ADA2 S266W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRWKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 224 - protein, 482 aa, Artificial Sequence
  human ADA2 S266Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRYKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 225 - protein, 482 aa, Artificial Sequence
  human ADA2 K267A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSADVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 226 - protein, 482 aa, Artificial Sequence
  human ADA2 K267C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSCDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 227 - protein, 482 aa, Artificial Sequence
  human ADA2 K267D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSDDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 228 - protein, 482 aa, Artificial Sequence
  human ADA2 K267E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSEDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 229 - protein, 482 aa, Artificial Sequence
  human ADA2 K267F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSFDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 230 - protein, 482 aa, Artificial Sequence
  human ADA2 K267G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSGDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 231 - protein, 482 aa, Artificial Sequence
  human ADA2 K267H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSHDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 232 - protein, 482 aa, Artificial Sequence
  human ADA2 K267I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSIDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 233 - protein, 482 aa, Artificial Sequence
  human ADA2 K267L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSLDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 234 - protein, 482 aa, Artificial Sequence
  human ADA2 K267M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSMDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 235 - protein, 482 aa, Artificial Sequence
  human ADA2 K267N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSNDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 236 - protein, 482 aa, Artificial Sequence
  human ADA2 K267P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSPDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 237 - protein, 482 aa, Artificial Sequence
  human ADA2 K267Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSQDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 238 - protein, 482 aa, Artificial Sequence
  human ADA2 K267R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSRDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 239 - protein, 482 aa, Artificial Sequence
  human ADA2 K267S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSSDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 240 - protein, 482 aa, Artificial Sequence
  human ADA2 K267T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSTDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 241 - protein, 482 aa, Artificial Sequence
  human ADA2 K267V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSVDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 242 - protein, 482 aa, Artificial Sequence
  human ADA2 K267W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSWDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 243 - protein, 482 aa, Artificial Sequence
  human ADA2 K267Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSYDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 244 - protein, 482 aa, Artificial Sequence
  human ADA2 V296A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLAGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 245 - protein, 482 aa, Artificial Sequence
  human ADA2 V296C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLCGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 246 - protein, 482 aa, Artificial Sequence
  human ADA2 V296D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLDGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 247 - protein, 482 aa, Artificial Sequence
  human ADA2 V296E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLEGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 248 - protein, 482 aa, Artificial Sequence
  human ADA2 V296F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLFGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 249 - protein, 482 aa, Artificial Sequence
  human ADA2 V296G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLGGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 250 - protein, 482 aa, Artificial Sequence
  human ADA2 V296H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLHGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 251 - protein, 482 aa, Artificial Sequence
  human ADA2 V296I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLIGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 252 - protein, 482 aa, Artificial Sequence
  human ADA2 V296K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLKGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 253 - protein, 482 aa, Artificial Sequence
  human ADA2 V296L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLLGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 254 - protein, 482 aa, Artificial Sequence
  human ADA2 V296M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLMGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 255 - protein, 482 aa, Artificial Sequence
  human ADA2 V296N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLNGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 256 - protein, 482 aa, Artificial Sequence
  human ADA2 V296P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLPGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 257 - protein, 482 aa, Artificial Sequence
  human ADA2 V296Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLQGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 258 - protein, 482 aa, Artificial Sequence
  human ADA2 V296R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLRGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 259 - protein, 482 aa, Artificial Sequence
  human ADA2 V296S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLSGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 260 - protein, 482 aa, Artificial Sequence
  human ADA2 V296T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLTGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 261 - protein, 482 aa, Artificial Sequence
  human ADA2 V296W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLWGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 262 - protein, 482 aa, Artificial Sequence
  human ADA2 V296Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLYGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 263 - protein, 482 aa, Artificial Sequence
  human ADA2 R219Q/K371E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 264 - protein, 482 aa, Artificial Sequence
  human ADA2 R219Q/K371D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 265 - protein, 482 aa, Artificial Sequence
  human ADA2 R219Q/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 266 - protein, 482 aa, Artificial Sequence
  human ADA2 R219Q/K371E/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 267 - protein, 482 aa, Artificial Sequence
  human ADA2 R219Q/K371D/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 268 - protein, 482 aa, Artificial Sequence
  human ADA2 R219Q/S262N/K371E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 269 - protein, 482 aa, Artificial Sequence
  human ADA2 R219Q/S262N/K371D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 270 - protein, 482 aa, Artificial Sequence
  human ADA2 R219Q/S262N/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 271 - protein, 482 aa, Artificial Sequence
  human ADA2 R219Q/S262N/K371E/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 272 - protein, 482 aa, Artificial Sequence
  human ADA2 R219Q/S262N/K371D/R20E, mature numbering
IDETRAHLLLKEKMMRLGGELVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 273 - protein, 482 aa, Artificial Sequence
  human ADA2 R219Q/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 274 - protein, 485 aa, Artificial Sequence
  human ADA2 I1insNAS, mature numbering
NASIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 275 - protein, 482 aa, Artificial Sequence
  human ADA2 R20N/V22S, mature numbering
IDETRAHLLLKEKMMRLGGNLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 276 - protein, 482 aa, Artificial Sequence
  human ADA2 K371N/D373S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWNKSIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 277 - protein, 482 aa, Artificial Sequence
  human ADA2 K372N/I374S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKNDSPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 278 - protein, 482 aa, Artificial Sequence
  human ADA2 T403N/H405S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMANGSPMVISSDDPAMFGAKGLSYDFYEVFMGIGGMKADLRTLKQLAMNSIKYSTLLESEKNTFMEIWKKRWDKFIADVATK

SEQ ID NO: 279 - protein, 482 aa, Artificial Sequence
  human ADA2 G404N/P406S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATNHSMVISSDDPAMFGAKGLSYDFYEVFMGIGGMKADLRTLKQLAMNSIKYSTLLESEKNTFMEIWKKRWDKFIADVATK

SEQ ID NO: 280 - protein, 440 aa, Artificial Sequence
  human ADA2 C105-T147del->(Gly)n, mature numbering, where n = 2 to 20
  REPEAT (105)...(105): occurring 2, 3, 4, 5, 6, 7, 8, 9, 10, 11, 12, 13, 14, 15, 16, 17, 18, 19 or 20 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 281 - protein, 454 aa, Artificial Sequence
  human ADA2 C105-T147del->(Gly)15, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 282 - protein, 449 aa, Artificial Sequence
  human ADA2 C105-T147del->(Gly)10, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 283 - protein, 446 aa, Artificial Sequence
  human ADA2 C105-T147del->(Gly)7, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 284 - protein, 444 aa, Artificial Sequence
  human ADA2 C105-T147del->(Gly)5, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 285 - protein, 442 aa, Artificial Sequence
  human ADA2 C105-T147del->(Gly)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 286 - protein, 511 aa, Pan troglodytes
  ADA2 (CECR1)
  SIGNAL (1)...(29)
  ref <308>: DATABASE ACCESSION NUMBER: NCBI XP_003317127.1
  ref <309>: DATABASE ENTRY DATE: 2012-10-05
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRTSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGHEDTGHSLHDYKEALMIPAKVGVKLPYFFHAGETDWQGTSIDRNILDALMLNTSRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 287 - protein, 511 aa, Gorilla gorilla
  ADA2 (CECR1)
  SIGNAL (1)...(29)
  ref <308>: DATABASE ACCESSION NUMBER: NCBI XP_004063024.1
  ref <309>: DATABASE ENTRY DATE: 2012-12-03
MLVDGPSERPALRFLLLAVAMSFFGSALSIDETRAHLLLKEKMMRLGGRLVLNTKEELANERLMTLKIAEMKEAMRTLIFPPSMHFFQAKHLIERSQVFNVLRMMPKGAALHLHDIGIVTMDWLVRNVTYRPHCHICFTPRGIMQFRFAHPTPRTSEKCSKWILLEDYRKQVQNVTEFDDSLLRNFTLVTQHPEVIYTNQNVVWSKFENIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 288 - protein, 511 aa, Pan paniscus
  ADA2 (CECR1)
  SIGNAL (1)...(29)
  ref <308>: DATABASE ACCESSION NUMBER: NCBI XP_003828345.1
  ref <309>: DATABASE ENTRY DATE: 2014-09-02
MLVDGPSERPALCFLLLAVAMSFFSSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRTSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGHEDTGHSLHDYKEALMIPAKVGVKLPYFFHAGETDWQGTSIDRNILDALMLNASRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 289 - protein, 511 aa, Pongo abelii
  ADA2 (CECR1)
  SIGNAL (1)...(29)
  ref <308>: DATABASE ACCESSION NUMBER: NCBI NP_001125360.1
  ref <309>: DATABASE ENTRY DATE: 2014-09-28
MLVDGPSEWPALRFLLLAVAMSFFGSALSIDETRAHLLLKEKMMRLGGRLVLNTKEEQANERLMMLKIAEMKEAMRTLIFPPSMHFFQAKHLIERSQVFNILRMMPKGAALHLHDIGIVTMDWLVRNVTYRPHCHICFTPKGIMQFRFAHPTPRTSEKCSKWILLEDYRKRVQNVTEFDDSLLRNFTLVTQHPEVIYTNQNVVWSKFETIFFTISGLIHYAPVFRDYVFQSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGREDTGHSLQDYKEALMIPAKGGVKLPYFFHAGETDWQGTSIDRNILDALMLNTTRIGHGFALSKHPAVRAYSWKKDIPIEVCPISNQVLKLVSDLRNHPVATLMATGHPMVISSDDPAIFGAKGLSYDFYEVFMGIGGMKADLRTLKQLAMNSIKYSALLEIEKNTFMEIWKKRWDKFIADVATK

SEQ ID NO: 290 - protein, 504 aa, Nomascus leucogenys
  ADA2 (CECR1)
  SIGNAL (1)...(29)
  UNSURE (230)...(230): Xaa = unknown
  ref <308>: DATABASE ACCESSION NUMBER: NCBI: XP_004088517.1
  ref <309>: DATABASE ENTRY DATE: 2013-02-15
MLVDGPSEWPALRFLLLAVAMSFFGSALSIDETRAHLLLKEKMMRLGGRLVLSTKEEQANERLMTLKITEMKEAMKTLIFPPSMHFFQAKHLIERSQVFNILRMMPKGAALHLHDIGIVTMDWLVRNVTYRPHCHICFTPKGIMQFRFAHPTPRTSEKCSKWILLEDYRKRVQNVTEFDDSLLRNFTLVTQHPEVIYTNQNVVWSKFETIFFTISGLIHYAPVFRDYVFXDNVLYMEIRARLLPVYELSGEHHDEEWSVKTYQEVAQKFVETHPEFIGIKIIYSDHRSKDVAVIAESIRTAMGLRAKFPTVVAGFDLVGHEDTGHSLHDYKEALMIPTKDGVKLPYFFHAGETDWQGTSIDKNILDALMLNTTRIGHGFALSKHPAVRAYSWKKDIPIEVCPISNQVLKLVSDLRNHPVATLMATGHPMVISSDDPAIFGAKGLSYDFYEVFMGIGGMKADLRTLKQLAMNSIKYSTLLETEKNTFMEIWKKRWDKFIADVATK

SEQ ID NO: 291 - protein, 509 aa, Macaca fascicularis
  ADA2 (CECR1)
  SIGNAL (1)...(29)
  ref <308>: DATABASE ACCESSION NUMBER: NCBI XP_005568111.1
  ref <309>: DATABASE ENTRY DATE: 2013-09-19
MLVDGPSEWPALRFLLLAVAMSFFRSALSIDEAHLLLKEKMMRLGGPLVLTTKEEQANERLMTLKIAEMKEAMKTLIFPPSMHFFQAKHLIERSQVFNILRMMPKGAALHLHDTGIVTMDWLVRNVTYRPHCHICFTSKGIMQFRFAHPTPRTSEKCSKWILLEDYRKRVQNVTEFDDSLLRNFTLVTQHPEVIYTNQNVVWSKFQTIFFTISGLIRYAPVFRDYVFRSMQEFYEDNVLYMEIRARLLPVYELSGEHHDEEWSVKTYQEVAQKFVETHPEFIGIKIIYSDDRSKDVTVIAESIRTAMGLRTKFPTVVAGFDLVGHEDTGHSLHYYKEALMIPARDGGKLPYFFHAGETDWQGTSIDKNILDALMLNTTRIGHGFALSKHPAARAYSWEKDIPIEVCPISNQVLKLVSDLRNHPVAALMAIGHPMVISSDDPAMFGAKGLSYDFYEAFMGIGGMKADLRTLKQLAMNSIRYSTLLETEKNTFMEIWKKRWDKFIADVATK

SEQ ID NO: 292 - protein, 509 aa, Chlorocebus sabaeus
  ADA2 (CECR1)
  SIGNAL (1)...(29)
  ref <308>: DATABASE ACCESSION NUMBER: NCBI: XP_007972990.1
  ref <309>: DATABASE ENTRY DATE: 2014-05-14
MSADGPSEWPSLRFLLLAVAMSFFRSALSIDEAHLLLKEKMMRLGGPLVLTTKEEQANERLMRLKIAEMKEAMKTLIFPPSMHFFQAKHLIERSQVFNILRMMPKGAALHLHDTGIVTMDWLVRNVTYRPHCHICFTSKGIMQFKFAHPTPRTSEKCSKWILLEDYRKRVQNVTEFDDSLLRNFTLVTQHPEVIYTNQNVVWSRFQTIFFTISGLIRYAPVFRDYVFRSMQEFYEDNVLYMEIRARLLPVYELSGEHHDEEWSVKTYQEVAQKFVETHPEFIGIKIIYSDDRFKDVTVIAESIRTAMGLRTKFPTVVAGFDLVGHEDTGHSLHDYKDALMIPARDGVKLPYFFHAGETDWQGTSIDKNILDALMLNTSRIGHGFALSKHPAARAYSWEKDIPIEVCPISNQVLKLVSDLRNHPVAALMAIGHPMVISSDDPAMFGAKGLSYDFYEAFMGIGGMKADLRTLKQLAMNSIRYSTLLETEKNTFMEIWKKRWDKFIADVATK

SEQ ID NO: 293 - protein, 509 aa, Macaca mulatta; identical to SEQ ID NO: 291
  ADA2 (CECR1)
  SIGNAL (1)...(29)
  ref <308>: DATABASE ACCESSION NUMBER: GenBank: AFH32795.1
  ref <309>: DATABASE ENTRY DATE: 2012-04-30

SEQ ID NO: 294 - protein, 511 aa, Callithrix jacchus
  ADA2 (CECR1)
  SIGNAL (1)...(29)
  ref <308>: DATABASE ACCESSION NUMBER: NCBI: XP_009004591.1
  ref <309>: DATABASE ENTRY DATE: 2014-09-02
MLGNGPSGWSALCFLLLAAAVSFFGSALSMDETREHLLTKEKMMQLGGQLVLNIKEERANEKLMTLKVTEMKEAMKTLLFPPSMHFFRAKHLIDRSQVFNILRMMPKGAALHLHDIGIVTMDWLVRNVTYRPHCHICFTTKGIVQFRFAHPTPRTSEECPKWILLEDYRRRVQNVTDFDDSLLRNFTLVTQHPEVIYTDQNAVWSKFKTIFSTISGLIHYAPVFRDYVFQSMQEFYEDNVLYMEIRARLLPVYELSGEQHDLQWSVKGYQEVAEKFVETHPEFIGIKIIYSDHRSKDVTVIAGSIRTAMGLRTKFPTVVAGFDLVGREDTGHSLHYHNRALMIPAKDGVKLPYFFHAGETDWQGTSIDKNILDALMLNTTRIGHGFALNKHPALRAYSRKKDVPVEVCPISNQVLKLVSDLRNHPAATLMATGHPMVISSDDPAIFGAKGLSYDFYEVFMGIGGMKADLRTLKQLAINSIKYSSLLETEKNTFMAVWKKRWDKFIAHVATD

SEQ ID NO: 295 - protein, 510 aa, Xenopus laevis
  ADA2 (CECR1)
  SIGNAL (1)...(19)
  ref <308>: DATABASE ACCESSION NUMBER: NCBI: NP_001090531.1
  ref <309>: DATABASE ENTRY DATE: 2014-05-14
MACVSHWLLLLSLASATLSRPLWSERNGLIEMENSIRLGGNIILTPSEATANQKLMTVKGAEFKEAESTGLFPPSMHFFKARPLIQQSHVFSILRQMPKGGALHLHDFAILSVDWLVKNASYMADCYMCLTRDGGVRFLFAKPAPVGMLPPGCSEWILLETYRKKLGDVTEFDKGLIRNLTLLTDSPEPHIPSQDEIWRRFEGAFITASGLICYAPVFKEYFYESLRELYEDNIQYLEMRAMLPPVYELDGTVHDQFWSMAIYRDMANKFVGAHPDFLGAKIIYTVHRHEDLAQVTEAVHLAMKLMEAFPEIMAGFDLVGQEDAGHSLYQLSDALNIPSKLGVKLPYFFHAGETNWQGKDVDENVLDALLLNTTRIGHGYALLKHPVARNLSLELNVPLEICPISNQVLLLVSDLRNHPAAVLMAEGHPLVVSSDDPSIFGAQGISYDFYEMFMGIGGAKADLRTLKKLAENSIKYSALSKEGKEKLTEIWQKKWDKFIKDLAMNWKKEL

SEQ ID NO: 296 - protein, 553 aa, Drosophila melanogaster
  ADA2 (ADGF isoform A)
  SIGNAL (1)...(30)
  ref <308>: DATABASE ACCESSION NUMBER: GenBank: AAL40913.1
  ref <309>: DATABASE ENTRY DATE: 2001-12-13
MSPVIRRNLIACLTLGLCVCLSFGPGPVESRTRPKNQVDRKLLTIYGSTPHVEALLGPGRPTPDTYKTLRSAFFRYEESRSLGHDLDLNSREIKANETIMKAKLKEFDEGLVTPHLFKPSQHIFDVLDGIRNTDLFKLLKKMPKGAVLHAHDTALCSTAAIINLTYYEHLWSCQQDGDLSASALRFSKDKPQALSDCDWSLLSDVRAKYGADKVDDYLAERLTLYPTKKFEDNNAAWSTFMSIFNLLDGLVMYAPVWADYYYKALEEFYEDGVLYLEFRSVVPTLYDMDGTEFTPMDTVRIYVETLEKFKEAHPDFIGSRMIYAPIRYTNAEGVTGYIQTLKQIKEKYPEFVAGFDLVGQEEMGRPLRDFVDELLSIPDDIDFYFHAGETNWFGSTVDENLIDAILLGTKRIGHGFGLVKHPVVLDMLKKLNVAIEVNPISNQVLQLVSDFRNHPCSHFFADGYPVVISSDDPSFWKATPLTHDFYIAFLGIASQHSDLRLLKKLALNSIQYSSLTGDAQFEALEKWQVKWDQFIADVNDRSSNRGSPSQRID

SEQ ID NO: 297 - protein, 520 aa, Drosophila melanogaster
  ADA2 (ADGF isoform B)
  ref <308>: DATABASE ACCESSION NUMBER: GenBank: AAL40920.1
  ref <309>: DATABASE ENTRY DATE: 2001-12-13
MTAIKHVAISCRRALTKCAKIGHTTVSVSRSLRKLSPTAFKTLRQAIAKVGHLNIMGQKIRLNDRELAANKVIMAVKKEEISKGILDPSQFTPGQHIFKTLAEVQKSPIFNLIKGMPKGGALHAHDTALCSTDYLISLTYRKNLWICTAEEGCKAIAFRFSKEEPKEKPVKESIWEPMEEFRERRGEENVTKYLTRRFSMYPFSKFISNNQAWAHFMGIFILLDGLLCHAPIWAEYYYNALKEFAEDGVQYLELRSLLPPLYCIDGDMLTIRDTVAIYNSELERFRADHPDFIGSKLIYAPLRGVEPSVVEQYVKTAVELNKEFPNFMVGFDLVGQEELGRPLIDFVEPLLKMPEHINFYFHAGETNWFGSPIDENLVDAILLGTKRIGHGYALTKHPMMMRLAKLLGIAIEVCPVSNQVLQLGVDYRNHPAALLLAANVPIVISSDDPSFWHCAPLSHDFYFAFLGIAPMKADLRFLKSLAINSIRYSALVGEEKRVGYRKWQEKWDKWIDDVVEHKYC

SEQ ID NO: 298 - protein, 506 aa, Drosophila melanogaster
  ADA2 (ADGF isoform C)
  SIGNAL (1)...(19)
  ref <308>: DATABASE ACCESSION NUMBER: GenBank: AAL40911.1
  ref <309>: DATABASE ENTRY DATE: 2001-12-13
MRRLLMFVVLLTAQLQIQAQTALSYEQARQAVLTAEEELMTGGHTHLNTEEEKVDDIFMEYKLGELAQGFRNAEQNAAALHFFKAKPLIDRSAIFRFLQKMPKGSVLHVHNTASVSSKWVVDDLSYMPGLLRCTTATGQSILSFRRTPKEHKCQSQYVLVSDERRNSLDRQVYDRNFERLINLYTPVPELEYPTITRVWDRFQGMFDGLSDALIYLPAFRAYHWQMLEELYNDNVMYTEIRTSFKTLYDASGRTFPRERTIHELYALNQKFMKLHPDFLGFKVIMAVYRGYELDHLKDIVEVFKKLHQALPHFLVGFDLVGQEDKGKPLYSLLPVLRDLPPTARLFLHGGETNWFGASTDINLLDALLMNTTRIGHGYALAKHPILLNAVKSRRIAVELSPISNQVLHLVWDLRNHPGSQFFALDVPVVICNDDPGFWNAKGLSYDFYYAIMSLAPNNAGLRLLKTLVWNSVRYSTLTEEEQTRAFKILELSWSRFIDDVLEGSVF

SEQ ID NO: 299 - protein, 502 aa, Drosophila melanogaster
  ADA2 (ADGF isoform D)
  SIGNAL (1)...(22)
  ref <308>: DATABASE ACCESSION NUMBER: GenBank: AAL40912.1
  ref <309>: DATABASE ENTRY DATE: 2001-12-13
MAMWFLGALVATVVLLTGSVQATDLPYETLREQIMEAERVASLGGNIWLSSDEEKANSILMNAKRAEIAEGLKTPEKYAPAMHFFQGRQYVRQSEVFRMIQKIPKGAFLHGHNTGMVTSRWIIQNLTTTNNLYTCRNVDGLLVFTYDQSGCHSEVQNVCTERINAEDRGKYERQLEKHINMHGPRPEALLPNRKKIWERFENIFTTVDRLYKYRPTYCAYHKRMLEELCEDNIIYAEIRASLSPLYDDNNRTLSTLEVANELERIVEEFKAKHHDFIGVKVIYAKRNRASEEEMLRRITTFKQLHHAKPNFVIGFDLIGQEDTGEPLNRYINQLSDLPSTANYFFHAGETNWNGRTDWNMMDAILLNTKRIGHAFALPKHPQLWSTIKKRNIAIEVNPISNQVLGFVWDLRNHPASFLIAENFPIVISSDDPGVWGAKGLSYDFYYAFMALAPADADLRFLKQLALNSIKYAVLTSDERRKINRVFQRKWQEFIANVLNPKF

SEQ ID NO: 300 - protein, 539 aa, Drosophila melanogaster
  ADA2 (ADGF isoform E)
  ref <308>: DATABASE ACCESSION NUMBER: GenBank: AAL40910
  ref <309>: DATABASE ENTRY DATE: 2001-12-13
MTVLLSHRMLLAGWARRATPTAAQWIHHNPEKMTLLEMLGTTNLRKSTPKDYRILREIFNSFERYSGVGNDIQLTLPERAANELIMCEKKREYEKGIMDPSKFAPGHHIFQVLTKVKKSPLFQILRRMPKGAALKAHDTSMCSSRVVIEITYRDNLWVCTTQNGCRVEEFRFAKDKPKDVSFENGEWQPMEKLRELRGEENLRKYLQMRFSMYPLASFTTNAHAWRHMMGIFGLLDGLLQYAPVWGDYYYNALKEFYADGVQYLEVRSVLPQLYSLDGSRMPKRETVQIYKDTLERFKKEHPGFIDSKLIYAPIRHVQPELVGEYIKECTELNKEFPSFVVGFDLVGQEDVGHPLSNFAAELLKLPDHIHFYFHAGQTNWYGSHVDQNLLDAIVLGTKRIGHGYTITKHPVLMRLAKYLNIALEVCPVSNQVLQLGSDYRSHPAATLIAENVPMVIASGSPGFWRAAPLSHDFYMAFLGIAPMNADLKFLKRTAKNSIKYSSLKDEAKAEAMEKWKKQWDKWVENIVRQRKKDSETEKK

SEQ ID NO: 301 - protein, 501 aa, Bombyx mori
  ADA2 (ADGF)
  SIGNAL (1)...(16)
  ref <308>: DATABASE ACCESSION NUMBER: NCBI: NP_001098698.1
  ref <309>: DATABASE ENTRY DATE: 2013-04-17
MFKIILFASFVVCIVADPPDINEYHRRRNTLSRNELRLTVGGNMTLSDKESEVNNCIMQLKFQEIDYAFDHPRYYNFSQHYFKYKDTMRKRRLYQILKVMPKGALLHVHDMSLLGPDYLMNITYMQDLYVCLYKETVGFRFSSKTPNAPCKGKWQDISKVRSSVENVTKFDEELRKHFTLVVDDPDTVYGCITDTWTKFMDYFLTVDPLLTYRPVWEKYFYDALMKFREDNVLYVEFRSVLPSLYELDGTAFDPVVTAKAYRKVIRKFVKDYPDFIGAKLIYAPSRRVNRSVLSTYLQIAKDVKNDMPDIFAGFDLVGQEDLGEPLIEFAPQLLEASESLDYFFHAGETDWLGTLTDENLMDAILLGAKRIGHAYALAKHPLLLEEVIKNDIGLEINIISNAVLSLVRDVRNHPLSTFLSKGLPVVISSDDPGAWEAEPLTDDFYVAFVGAASRLADLRLLKQLALNSFTYSSLEDRQKIEALRRFKRNWDSFINNFKCPL

SEQ ID NO: 302 - protein, 553 aa, Sarcophaga peregrina
  ADA2 (IDGF)
  SIGNAL (1)...(18)
  ref <308>: DATABASE ACCESSION NUMBER: GenBank: BAA11812.1
  ref <309>: DATABASE ENTRY DATE: 2007-03-16
MPALKTLGTLCVLMLVFAHNEARRASLRANHMVQHAPHIEPQASVIGGRPTPEAYNSLRDIFFRYEESKTLGADITLTQKELQANQLIMEAKTREYEEGLATPHLFTPSQHLFEVLDDIKQSPLFKYISSMPKGAVLHAHDTALCSTDFLIRLTYRDNLWVCQGKGDKEVIGMRFSKTKPDVATQADCTWELLSKVRELHGADKVDTYLREHLTLYPTVKFLDNNEAWEQFGSIFALLDGLLFYAPSWADYYYNALKEFHADGVQYLEFRSTLPILYDLEGTSFTELDTVRIYKETLDKYMAEHIDFIGSKLIYAPIRNTDKEGLDNYIKVCVEIKEKYPDFVAGFDLVGQEEKGRPLKDFIPQLLGMPENIDFYFHAGETNWFGSTVDENLIDAVLLGTKRIGHGFALVKHPLVLQMLKERNIAIEVNPISNQVLQLVADYRNHPCAYFFADNYPVVISSDDPSFWKATPLSHDFYIAFLGIASAHSDMRLLKKLALNSINYSSLSPEQKRVALAKWQIKWDDFIDEVLSGNYDNNGSNNAAQHRLNTNKII

SEQ ID NO: 303 - protein, 32 aa, Artificial Sequence
  C-terminal peptide (CTP) of the beta Subunit of Human Chorionic Gonadotropin
DPRFQDSSSSKAPPPSLPSPSRLPGPSDTPIL

SEQ ID NO: 304 - protein, 28 aa, Artificial Sequence
  C-terminal peptide (CTP) of the beta Subunit of Human Chorionic Gonadotropin
SSSSKAPPPSLPSPSRLPGPSDTPILPQ

SEQ ID NO: 305 - protein, 609 aa, Homo sapiens [sequence omitted]

SEQ ID NO: 306 - protein, 6 aa, Artificial Sequence
  Albumin Binding Consensus Sequence
  VARIANT (2)...(2): Xaa = Asp, Asn, Ser, Thr or Trp
  VARIANT (3)...(3): Xaa = Asn, Gln, His, Ile, Leu or Lys
  VARIANT (4)...(4): Xaa = Ala, Asp, Phe, Trp or Tyr
  VARIANT (5)...(5): Xaa = Asp, Gly, Leu, Phe, Ser or Thr
CXXXXC

SEQ ID NO: 307 - protein, 11 aa, Artificial Sequence
  albumin-binding peptide
DICLPRWGCLW

SEQ ID NO: 308 - protein, 18 aa, Artificial Sequence
  albumin-binding peptide
RLIEDICLPRWGCLWEDD

SEQ ID NO: 309 - protein, 20 aa, Artificial Sequence
  albumin-binding peptide
QRLMEDICLPRWGCLWEDDF

SEQ ID NO: 310 - protein, 21 aa, Artificial Sequence
  albumin-binding peptide
QGLIGDICLPRWGCLWGDSVK

SEQ ID NO: 311 - protein, 20 aa, Artificial Sequence
  albumin-binding peptide
GEWWEDICLPRWGCLWEEED

SEQ ID NO: 312 - protein, 20 aa, Artificial Sequence
  PAS sequence
ASPAAPAPASPAAPAPSAPA

SEQ ID NO: 313 - protein, 20 aa, Artificial Sequence
  PAS sequence
AAPASPAPAAPSAPAPAAPS

SEQ ID NO: 314 - protein, 20 aa, Artificial Sequence
  PAS sequence
APSSPSPSAPSSPSPASPSS

SEQ ID NO: 315 - protein, 19 aa, Artificial Sequence
  PAS sequence
APSSPSPSAPSSPSPASPS

SEQ ID NO: 316 - protein, 20 aa, Artificial Sequence
  PAS sequence
SSPSAPSPSSPASPSPSSPA

SEQ ID NO: 317 - protein, 24 aa, Artificial Sequence
  PAS sequence
AASPAAPSAPPAAASPAAPSAPPA

SEQ ID NO: 318 - protein, 20 aa, Artificial Sequence
  PAS sequence
ASAAAPAAASAAASAPSAAA

SEQ ID NO: 319 - DNA, 2808 bp, Homo sapiens
  transferrin (TF)
  ref <308>: DATABASE ACCESSION NUMBER: NCBI: NM_001063
  ref <309>: DATABASE ENTRY DATE: 2014-05-25
tggcaccgagcgagccgcgatgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgtaaaaaaaaaaaaaaaaaa

SEQ ID NO: 320 - protein, 698 aa, Homo sapiens
  serotransferrin precursor
  SIGNAL (1)...(19)
  ref <308>: DATABASE ACCESSION NUMBER: NCBI: NP_001054.1
  ref <309>: DATABASE ENTRY DATE: 2014-05-14
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 321 - DNA, 2298 bp, Homo sapiens
  transferrin (TF)
  ref <308>: DATABASE ACCESSION NUMBER: GenBank: M12530.1
  ref <309>: DATABASE ENTRY DATE: 1995-01-14
tgtgctcgctgctcagcgcgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacttggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctagacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtccccccaaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 322 - DNA, 2299 bp, Homo sapiens
  transferrin (TF)
  ref <308>: DATABASE ACCESSION NUMBER: NCBI: XM_039845.1
  ref <309>: DATABASE ENTRY DATE: 2001-07-16
tgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctctgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 323 - DNA, 2347 bp, Homo sapiens
  transferrin (TF)
  unsure (44)...(44): n = unknown
  ref <308>: DATABASE ACCESSION NUMBER: GenBank: S95936.1
  ref <309>: DATABASE ENTRY DATE: 2003-05-07
acggcgagcctcatcctccgggtgcggcgctgagcagcgagtcncgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcaggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttaaaaaaa

SEQ ID NO: 324 - protein, 698 aa, Homo sapiens; identical to SEQ ID NO: 320
  transferrin (TF)
  ref <308>: DATABASE ACCESSION NUMBER: GenBank: AAB22049.1
  ref <309>: DATABASE ENTRY DATE: 1993-05-07

SEQ ID NO: 325 - protein, 698 aa, Homo sapiens; identical to SEQ ID NO: 320
  transferrin
  SIGNAL (1)...(19)
  ref <308>: DATABASE ACCESSION NUMBER: GenBank: AAA61140.1
  ref <309>: DATABASE ENTRY DATE: 1995-01-14

SEQ ID NO: 326 - protein, 482 aa, Pan troglodytes
  ADA2 (CECR1) mature form
  ref <308>: DATABASE ACCESSION NUMBER: NCBI: XP_003317127.1
  ref <309>: DATABASE ENTRY DATE: 2012-10-05
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRTSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGHEDTGHSLHDYKEALMIPAKVGVKLPYFFHAGETDWQGTSIDRNILDALMLNTSRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 327 - protein, 482 aa, Gorilla gorilla
  ADA2 (CECR1) mature form
  ref <308>: DATABASE ACCESSION NUMBER: NCBI XP_004063024.1
  ref <309>: DATABASE ENTRY DATE: 2012-12-03
IDETRAHLLLKEKMMRLGGRLVLNTKEELANERLMTLKIAEMKEAMRTLIFPPSMHFFQAKHLIERSQVFNVLRMMPKGAALHLHDIGIVTMDWLVRNVTYRPHCHICFTPRGIMQFRFAHPTPRTSEKCSKWILLEDYRKQVQNVTEFDDSLLRNFTLVTQHPEVIYTNQNVVWSKFENIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 328 - protein, 482 aa, Pan paniscus
  ADA2 (CECR1) mature form
  ref <308>: DATABASE ACCESSION NUMBER: NCBI XP_003828345.1
  ref <309>: DATABASE ENTRY DATE: 2014-09-02
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRTSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGHEDTGHSLHDYKEALMIPAKVGVKLPYFFHAGETDWQGTSIDRNILDALMLNASRIGHGFALSKHPAVRTYSWEKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 329 - protein, 482 aa, Pongo abelii
  ADA2 (CECR1) mature form
  ref <308>: DATABASE ACCESSION NUMBER: NCBI NP_001125360.1
  ref <309>: DATABASE ENTRY DATE: 2014-09-28
IDETRAHLLLKEKMMRLGGRLVLNTKEEQANERLMMLKIAEMKEAMRTLIFPPSMHFFQAKHLIERSQVFNILRMMPKGAALHLHDIGIVTMDWLVRNVTYRPHCHICFTPKGIMQFRFAHPTPRTSEKCSKWILLEDYRKRVQNVTEFDDSLLRNFTLVTQHPEVIYTNQNVVWSKFETIFFTISGLIHYAPVFRDYVFQSMQEFYEDNVLYMEIRARLLPVYELSGEHHDEEWSVKTYQEVAQKFVETHPEFIGIKIIYSDHRSKDVAVIAESIRTAMGLRTKFPTVVAGFDLVGREDTGHSLQDYKEALMIPAKGGVKLPYFFHAGETDWQGTSIDRNILDALMLNTTRIGHGFALSKHPAVRAYSWKKDIPIEVCPISNQVLKLVSDLRNHPVATLMATGHPMVISSDDPAIFGAKGLSYDFYEVFMGIGGMKADLRTLKQLAMNSIKYSALLEIEKNTFMEIWKKRWDKFIADVATK

SEQ ID NO: 330 - protein, 475 aa, Nomascus leucogenys
  ADA2 (CECR1) mature form
  UNSURE (201)...(201): Xaa = unknown
  ref <308>: DATABASE ACCESSION NUMBER: NCBI XP_004088517.1
  ref <309>: DATABASE ENTRY DATE: 2013-02-15
IDETRAHLLLKEKMMRLGGRLVLSTKEEQANERLMTLKITEMKEAMKTLIFPPSMHFFQAKHLIERSQVFNILRMMPKGAALHLHDIGIVTMDWLVRNVTYRPHCHICFTPKGIMQFRFAHPTPRTSEKCSKWILLEDYRKRVQNVTEFDDSLLRNFTLVTQHPEVIYTNQNVVWSKFETIFFTISGLIHYAPVFRDYVFXDNVLYMEIRARLLPVYELSGEHHDEEWSVKTYQEVAQKFVETHPEFIGIKIIYSDHRSKDVAVIAESIRTAMGLRAKFPTVVAGFDLVGHEDTGHSLHDYKEALMIPTKDGVKLPYFFHAGETDWQGTSIDKNILDALMLNTTRIGHGFALSKHPAVRAYSWKKDIPIEVCPISNQVLKLVSDLRNHPVATLMATGHPMVISSDDPAIFGAKGLSYDFYEVFMGIGGMKADLRTLKQLAMNSIKYSTLLETEKNTFMEIWKKRWDKFIADVATK

SEQ ID NO: 331 - protein, 480 aa, Macaca fascicularis
  ADA2 (CECR1) mature form
  ref <308>: DATABASE ACCESSION NUMBER: NCBI XP_005568111.1
  ref <309>: DATABASE ENTRY DATE: 2013-09-19
IDEAHLLLKEKMMRLGGPLVLTTKEEQANERLMTLKIAEMKEAMKTLIFPPSMHFFQAKHLIERSQVFNILRMMPKGAALHLHDTGIVTMDWLVRNVTYRPHCHICFTSKGIMQFRFAHPTPRTSEKCSKWILLEDYRKRVQNVTEFDDSLLRNFTLVTQHPEVIYTNQNVVWSKFQTIFFTISGLIRYAPVFRDYVFRSMQEFYEDNVLYMEIRARLLPVYELSGEHHDEEWSVKTYQEVAQKFVETHPEFIGIKIIYSDDRSKDVTVIAESIRTAMGLRTKFPTVVAGFDLVGHEDTGHSLHYYKEALMIPARDGGKLPYFFHAGETDWQGTSIDKNILDALMLNTTRIGHGFALSKHPAARAYSWEKDIPIEVCPISNQVLKLVSDLRNHPVAALMAIGHPMVISSDDPAMFGAKGLSYDFYEAFMGIGGMKADLRTLKQLAMNSIRYSTLLETEKNTFMEIWKKRWDKFIADVATK

SEQ ID NO: 332 - protein, 480 aa, Chlorocebus sabaeus
  ADA2 (CECR1) mature form
  ref <308>: DATABASE ACCESSION NUMBER: NCBI: XP_007972990.1
  ref <309>: DATABASE ENTRY DATE: 2014-05-14
IDEAHLLLKEKMMRLGGPLVLTTKEEQANERLMRLKIAEMKEAMKTLIFPPSMHFFQAKHLIERSQVFNILRMMPKGAALHLHDTGIVTMDWLVRNVTYRPHCHICFTSKGIMQFKFAHPTPRTSEKCSKWILLEDYRKRVQNVTEFDDSLLRNFTLVTQHPEVIYTNQNVVWSRFQTIFFTISGLIRYAPVFRDYVFRSMQEFYEDNVLYMEIRARLLPVYELSGEHHDEEWSVKTYQEVAQKFVETHPEFIGIKIIYSDDRFKDVTVIAESIRTAMGLRTKFPTVVAGFDLVGHEDTGHSLHDYKDALMIPARDGVKLPYFFHAGETDWQGTSIDKNILDALMLNTSRIGHGFALSKHPAARAYSWEKDIPIEVCPISNQVLKLVSDLRNHPVAALMAIGHPMVISSDDPAMFGAKGLSYDFYEAFMGIGGMKADLRTLKQLAMNSIRYSTLLETEKNTFMEIWKKRWDKFIADVATK

SEQ ID NO: 333 - protein, 480 aa, Macaca mulatta; identical to SEQ ID NO: 331
  ADA2 (CECR1) mature form
  ref <308>: DATABASE ACCESSION NUMBER: GenBank: AFH32795.1
  ref <309>: DATABASE ENTRY DATE: 2012-04-30

SEQ ID NO: 334 - protein, 484 aa, Callithrix jacchus
  ADA2 (CECR1) mature form
  ref <308>: DATABASE ACCESSION NUMBER: NCBI: XP_009004591.1
  ref <309>: DATABASE ENTRY DATE: 2014-09-02
LSMDETREHLLTKEKMMQLGGQLVLNIKEERANEKLMTLKVTEMKEAMKTLLFPPSMHFFRAKHLIDRSQVFNILRMMPKGAALHLHDIGIVTMDWLVRNVTYRPHCHICFTTKGIVQFRFAHPTPRTSEECPKWILLEDYRRRVQNVTDFDDSLLRNFTLVTQHPEVIYTDQNAVWSKFKTIFSTISGLIHYAPVFRDYVFQSMQEFYEDNVLYMEIRARLLPVYELSGEQHDLQWSVKGYQEVAEKFVETHPEFIGIKIIYSDHRSKDVTVIAGSIRTAMGLRTKFPTVVAGFDLVGREDTGHSLHYHNRALMIPAKDGVKLPYFFHAGETDWQGTSIDKNILDALMLNTTRIGHGFALNKHPALRAYSRKKDVPVEVCPISNQVLKLVSDLRNHPAATLMATGHPMVISSDDPAIFGAKGLSYDFYEVFMGIGGMKADLRTLKQLAINSIKYSSLLETEKNTFMAVWKKRWDKFIAHVATD

SEQ ID NO: 335 - protein, 491 aa, Xenopus laevis
  ADA2 (CECR1) mature form
  ref <308>: DATABASE ACCESSION NUMBER: NCBI: NP_001090531.1
  ref <309>: DATABASE ENTRY DATE: 2014-05-14
RPLWSERNGLIEMENSIRLGGNIILTPSEATANQKLMTVKGAEFKEAESTGLFPPSMHFFKARPLIQQSHVFSILRQMPKGGALHLHDFAILSVDWLVKNASYMADCYMCLTRDGGVRFLFAKPAPVGMLPPGCSEWILLETYRKKLGDVTEFDKGLIRNLTLLTDSPEPHIPSQDEIWRRFEGAFITASGLICYAPVFKEYFYESLRELYEDNIQYLEMRAMLPPVYELDGTVHDQFWSMAIYRDMANKFVGAHPDFLGAKIIYTVHRHEDLAQVTEAVHLAMKLMEAFPEIMAGFDLVGQEDAGHSLYQLSDALNIPSKLGVKLPYFFHAGETNWQGKDVDENVLDALLLNTTRIGHGYALLKHPVARNLSLELNVPLEICPISNQVLLLVSDLRNHPAAVLMAEGHPLVVSSDDPSIFGAQGISYDFYEMFMGIGGAKADLRTLKKLAENSIKYSALSKEGKEKLTEIWQKKWDKFIKDLAMNWKKEL

SEQ ID NO: 336 - protein, 523 aa, Drosophila melanogaster
  ADA2 (ADGF isoform A) mature form
  ref <308>: DATABASE ACCESSION NUMBER: GenBank: AAL40913.1
  ref <309>: DATABASE ENTRY DATE: 2001-12-13
RTRPKNQVDRKLLTIYGSTPHVEALLGPGRPTPDTYKTLRSAFFRYEESRSLGHDLDLNSREIKANETIMKAKLKEFDEGLVTPHLFKPSQHIFDVLDGIRNTDLFKLLKKMPKGAVLHAHDTALCSTAAIINLTYYEHLWSCQQDGDLSASALRFSKDKPQALSDCDWSLLSDVRAKYGADKVDDYLAERLTLYPTKKFEDNNAAWSTFMSIFNLLDGLVMYAPVWADYYYKALEEFYEDGVLYLEFRSVVPTLYDMDGTEFTPMDTVRIYVETLEKFKEAHPDFIGSRMIYAPIRYTNAEGVTGYIQTLKQIKEKYPEFVAGFDLVGQEEMGRPLRDFVDELLSIPDDIDFYFHAGETNWFGSTVDENLIDAILLGTKRIGHGFGLVKHPVVLDMLKKLNVAIEVNPISNQVLQLVSDFRNHPCSHFFADGYPVVISSDDPSFWKATPLTHDFYIAFLGIASQHSDLRLLKKLALNSIQYSSLTGDAQFEALEKWQVKWDQFIADVNDRSSNRGSPSQRID

SEQ ID NO: 337 - protein, 544 aa, Macaca mulatta
  ADA2 (CECR1)
  ref <308>: DATABASE ACCESSION NUMBER: GenBank: EHH20002.1
  ref <309>: DATABASE ENTRY DATE: 2011-11-04
MLVDGPSEWPALRFLLLAVAMSFFRSALSIDEAHLLLKEKMMRLGGPLVLTTKEEQANERLMTLKIAEMKEAMKTLIFPPSMHFFQAKHLIERSQVFNILRMMPKGAALHLHDTGIVTMDWLVRNVTYRPHCHICFTSKGIMQFRFAHPTPRTSEKCSKWILLEDYRKRVQNVTEFDDSLLRNFTLVTQHPEVIYTNQNVVWSKFQTIFFTISGLIRYAPVFRDYVFRSMQEFYEDNVLYMEIRARLLPLSPLCSHCVPLLSLVALAALQLLHLELGKQCGGEQVYELSGEHHDEEWSVKTYQEVAQKFVETHPEFIGIKIIYSDDRSKDVTVIAESIRTAMGLRTKFPTVVAGFDLVGHEDTGHSLHYYKEALMIPARDGGKLPYFFHAGETDWQGTSIDKNILDALMLNTTRIGHGFALSKHPAARAYSWEKDIPIEVCPISNQVLKLVSDLRNHPVAALMAIGHPMVISSDDPAMFGAKGLSYDFYEAFMGIGGMKADLRTLKQLAMNSIRYSTLLETEKNTFMEIWKKRWDKFIADVATK

SEQ ID NO: 338 - protein, 487 aa, Drosophila melanogaster
  ADA2 (ADGF isoform C) mature form
  ref <308>: DATABASE ACCESSION NUMBER: GenBank: AAL40911.1
  ref <309>: DATABASE ENTRY DATE: 2001-12-13
QTALSYEQARQAVLTAEEELMTGGHTHLNTEEEKVDDIFMEYKLGELAQGFRNAEQNAAALHFFKAKPLIDRSAIFRFLQKMPKGSVLHVHNTASVSSKWVVDDLSYMPGLLRCTTATGQSILSFRRTPKEHKCQSQYVLVSDERRNSLDRQVYDRNFERLINLYTPVPELEYPTITRVWDRFQGMFDGLSDALIYLPAFRAYHWQMLEELYNDNVMYTEIRTSFKTLYDASGRTFPRERTIHELYALNQKFMKLHPDFLGFKVIMAVYRGYELDHLKDIVEVFKKLHQALPHFLVGFDLVGQEDKGKPLYSLLPVLRDLPPTARLFLHGGETNWFGASTDINLLDALLMNTTRIGHGYALAKHPILLNAVKSRRIAVELSPISNQVLHLVWDLRNHPGSQFFALDVPVVICNDDPGFWNAKGLSYDFYYAIMSLAPNNAGLRLLKTLVWNSVRYSTLTEEEQTRAFKILELSWSRFIDDVLEGSVF

SEQ ID NO: 339 - protein, 480 aa, Drosophila melanogaster
  ADA2 (ADGF isoform D) mature form
  ref <308>: DATABASE ACCESSION NUMBER: GenBank: AAL40912.1
  ref <309>: DATABASE ENTRY DATE: 2001-12-13
TDLPYETLREQIMEAERVASLGGNIWLSSDEEKANSILMNAKRAEIAEGLKTPEKYAPAMHFFQGRQYVRQSEVFRMIQKIPKGAFLHGHNTGMVTSRWIIQNLTTTNNLYTCRNVDGLLVFTYDQSGCHSEVQNVCTERINAEDRGKYERQLEKHINMHGPRPEALLPNRKKIWERFENIFTTVDRLYKYRPTYCAYHKRMLEELCEDNIIYAEIRASLSPLYDDNNRTLSTLEVANELERIVEEFKAKHHDFIGVKVIYAKRNRASEEEMLRRITTFKQLHHAKPNFVIGFDLIGQEDTGEPLNRYINQLSDLPSTANYFFHAGETNWNGRTDWNMMDAILLNTKRIGHAFALPKHPQLWSTIKKRNIAIEVNPISNQVLGFVWDLRNHPASFLIAENFPIVISSDDPGVWGAKGLSYDFYYAFMALAPADADLRFLKQLALNSIKYAVLTSDERRKINRVFQRKWQEFIANVLNPKF

SEQ ID NO: 340 - protein, 515 aa, Macaca mulatta
  ADA2 (CECR1) mature form
  ref <308>: DATABASE ACCESSION NUMBER: GenBank: EHH20002.1
  ref <309>: DATABASE ENTRY DATE: 2011-11-04
IDEAHLLLKEKMMRLGGPLVLTTKEEQANERLMTLKIAEMKEAMKTLIFPPSMHFFQAKHLIERSQVFNILRMMPKGAALHLHDTGIVTMDWLVRNVTYRPHCHICFTSKGIMQFRFAHPTPRTSEKCSKWILLEDYRKRVQNVTEFDDSLLRNFTLVTQHPEVIYTNQNVVWSKFQTIFFTISGLIRYAPVFRDYVFRSMQEFYEDNVLYMEIRARLLPLSPLCSHCVPLLSLVALAALQLLHLELGKQCGGEQVYELSGEHHDEEWSVKTYQEVAQKFVETHPEFIGIKIIYSDDRSKDVTVIAESIRTAMGLRTKFPTVVAGFDLVGHEDTGHSLHYYKEALMIPARDGGKLPYFFHAGETDWQGTSIDKNILDALMLNTTRIGHGFALSKHPAARAYSWEKDIPIEVCPISNQVLKLVSDLRNHPVAALMAIGHPMVISSDDPAMFGAKGLSYDFYEAFMGIGGMKADLRTLKQLAMNSIRYSTLLETEKNTFMEIWKKRWDKFIADVATK

SEQ ID NO: 341 - protein, 485 aa, Bombyx mori
  ADA2 (ADGF) mature form
  ref <308>: DATABASE ACCESSION NUMBER: NCBI NP_001098698.1
  ref <309>: DATABASE ENTRY DATE: 2014-04-17
DPPDINEYHRRRNTLSRNELRLTVGGNMTLSDKESEVNNCIMQLKFQEIDYAFDHPRYYNFSQHYFKYKDTMRKRRLYQILKVMPKGALLHVHDMSLLGPDYLMNITYMQDLYVCLYKETVGFRFSSKTPNAPCKGKWQDISKVRSSVENVTKFDEELRKHFTLVVDDPDTVYGCITDTWTKFMDYFLTVDPLLTYRPVWEKYFYDALMKFREDNVLYVEFRSVLPSLYELDGTAFDPVVTAKAYRKVIRKFVKDYPDFIGAKLIYAPSRRVNRSVLSTYLQIAKDVKNDMPDIFAGFDLVGQEDLGEPLIEFAPQLLEASESLDYFFHAGETDWLGTLTDENLMDAILLGAKRIGHAYALAKHPLLLEEVIKNDIGLEINIISNAVLSLVRDVRNHPLSTFLSKGLPVVISSDDPGAWEAEPLTDDFYVAFVGAASRLADLRLLKQLALNSFTYSSLEDRQKIEALRRFKRNWDSFINNFKCPL

SEQ ID NO: 342 - protein, 535 aa, Sarcophaga perigrina
  ADA2 (IDGF) mature form
  ref <308>: DATABASE ACCESSION NUMBER: GenBank: BAA11812.1
  ref <309>: DATABASE ENTRY DATE: 2007-03-16
HNEARRASLRANHMVQHAPHIEPQASVIGGRPTPEAYNSLRDIFFRYEESKTLGADITLTQKELQANQLIMEAKTREYEEGLATPHLFTPSQHLFEVLDDIKQSPLFKYISSMPKGAVLHAHDTALCSTDFLIRLTYRDNLWVCQGKGDKEVIGMRFSKTKPDVATQADCTWELLSKVRELHGADKVDTYLREHLTLYPTVKFLDNNEAWEQFGSIFALLDGLLFYAPSWADYYYNALKEFHADGVQYLEFRSTLPILYDLEGTSFTELDTVRIYKETLDKYMAEHIDFIGSKLIYAPIRNTDKEGLDNYIKVCVEIKEKYPDFVAGFDLVGQEEKGRPLKDFIPQLLGMPENIDFYFHAGETNWFGSTVDENLIDAVLLGTKRIGHGFALVKHPLVLQMLKERNIAIEVNPISNQVLQLVADYRNHPCAYFFADNYPVVISSDDPSFWKATPLSHDFYIAFLGIASAHSDMRLLKKLALNSINYSSLSPEQKRVALAKWQIKWDDFIDEVLSGNYDNNGSNNAAQHRLNTNKII

SEQ ID NO: 343 - protein, 5 aa, Artificial Sequence
  linker
GGGGS

SEQ ID NO: 344 - protein, 5 aa, Artificial Sequence
  linker
SSSSG

SEQ ID NO: 345 - protein, 12 aa, Artificial Sequence
  linker
GKSSGSGSESKS

SEQ ID NO: 346 - protein, 15 aa, Artificial Sequence
  linker
GGSTSGSGKSSEGKG

SEQ ID NO: 347 - protein, 19 aa, Artificial Sequence
  linker
GSTSGSGKSSSEGSGSTKG

SEQ ID NO: 348 - protein, 18 aa, Artificial Sequence
  linker
GSTSGSGKPGSGEGSTKG

SEQ ID NO: 349 - protein, 14 aa, Artificial Sequence
  linker
EGKSSGSGSESKEF

SEQ ID NO: 350 - protein, 4 aa, Artificial Sequence
  linker
AAPA

SEQ ID NO: 351 - DNA, 27 bp, Artificial Sequence
  Gly4Ser with NcoI ends
ccatgggcggcggcggctctgccatgg

SEQ ID NO: 352 - DNA, 42 bp, Artificial Sequence
  (Gly4Ser)2  with NcoI ends
ccatgggcggcggcggctctggcggcggcggctctgccatgg

SEQ ID NO: 353 - DNA, 75 bp, Artificial Sequence
  (Ser4Gly)4 with NcoI ends
ccatggcctcgtcgtcgtcgggctcgtcgtcgtcgggctcgtcgtcgtcgggctcgtcgtcgtcgggcgccatgg

SEQ ID NO: 354 - DNA, 45 bp, Artificial Sequence
  (Ser4Gly)2  with NcoI ends
ccatggcctcgtcgtcgtcgggctcgtcgtcgtcgggcgccatgg

SEQ ID NO: 355 - protein, 330 aa, Homo sapiens [sequence omitted]

SEQ ID NO: 356 - protein, 326 aa, Homo sapiens
  hIgG2 heavy chain constant
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 357 - protein, 377 aa, Homo sapiens
  hIgG3 heavy chain constant
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 358 - protein, 327 aa, Homo sapiens
  hIgG4 heavy chain constant
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 359 - protein, 231 aa, Artificial Sequence
  hIgG1 Fc
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 5 aa, Artificial Sequence
  linker
GGGGG

SEQ ID NO: 361 - protein, 223 aa, Homo sapiens
  fragment of IgG1 heavy chain
TCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 362 - protein, 4 aa, Artificial Sequence
  linker
GGGG

SEQ ID NO: 363 - protein, 7 aa, Artificial Sequence
  linker
SGGSGGS

SEQ ID NO: 364 - protein, 15 aa, Artificial Sequence
  linker
GGSGGSGGSGGSGGG

SEQ ID NO: 365 - protein, 16 aa, Artificial Sequence
  linker
GGSGGSGGGGSGGGGS

SEQ ID NO: 366 - protein, 18 aa, Artificial Sequence
  linker
GGSGGSGGSGGSGGSGGS

SEQ ID NO: 367 - protein, 15 aa, Artificial Sequence
  linker
GGGGSGGGGSGGGGS

SEQ ID NO: 368 - protein, 1 aa, Artificial Sequence
  Linker (Gly)n, where n = 2 to 20
  REPEAT (1)...(1): occurring  2, 3, 4, 5, 6, 7, 8, 9, 10, 11, 12, 13, 14, 15, 16, 17, 18, 19 or 20 times
G

SEQ ID NO: 369 - protein, 3 aa, Artificial Sequence
  linker
GGG

SEQ ID NO: 370 - protein, 7 aa, Artificial Sequence
  linker
GGGGGGG

SEQ ID NO: 371 - protein, 10 aa, Artificial Sequence
  linker
GGGGGGGGGG

SEQ ID NO: 372 - protein, 15 aa, Artificial Sequence
  linker
GGGGGGGGGGGGGGG

SEQ ID NO: 373 - protein, 864 aa, Artificial Sequence
  XTEN
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 374 - protein, 523 aa, Callithrix jacchus
  ADA2 (CECR1)
  SIGNAL (1)...(27)
  ref <308>: DATABASE ACCESSION NUMBER: NCBI XP_009004586.1
  ref <309>: DATABASE ENTRY DATE: 2014-09-02
MLGNGPSGWSALCFLLLAAAVSFFGSALSMDETREHLLTKEKMMQLGGQLVLNIKEERANEKLMTLKVTEMKEAMKTLLFPPSMHFFRAKHLIDRSQVFNILRMMPKGAALHLHDIGIVTMDWLVRNVTYRPHCHICFTTKGIVQFRFAHPTPRTSEECPKWILLEDYRRRVQNVTDFDDRVHPGVLLLGDASLLRNFTLVTQHPEVIYTDQNAVWSKFKTIFSTISGLIHYAPVFRDYVFQSMQEFYEDNVLYMEIRARLLPVYELSGEQHDLQWSVKGYQEVAEKFVETHPEFIGIKIIYSDHRSKDVTVIAGSIRTAMGLRTKFPTVVAGFDLVGREDTGHSLHYHNRALMIPAKDGVKLPYFFHAGETDWQGTSIDKNILDALMLNTTRIGHGFALNKHPALRAYSRKKDVPVEVCPISNQVLKLVSDLRNHPAATLMATGHPMVISSDDPAIFGAKGLSYDFYEVFMGIGGMKADLRTLKQLAINSIKYSSLLETEKNTFMAVWKKRWDKFIAHVATD

SEQ ID NO: 375 - protein, 496 aa, Callithrix jacchus
  ADA2 (CECR1) mature form
  ref <308>: DATABASE ACCESSION NUMBER: NCBI XP_009004586.1
  ref <309>: DATABASE ENTRY DATE: 2014-09-02
LSMDETREHLLTKEKMMQLGGQLVLNIKEERANEKLMTLKVTEMKEAMKTLLFPPSMHFFRAKHLIDRSQVFNILRMMPKGAALHLHDIGIVTMDWLVRNVTYRPHCHICFTTKGIVQFRFAHPTPRTSEECPKWILLEDYRRRVQNVTDFDDRVHPGVLLLGDASLLRNFTLVTQHPEVIYTDQNAVWSKFKTIFSTISGLIHYAPVFRDYVFQSMQEFYEDNVLYMEIRARLLPVYELSGEQHDLQWSVKGYQEVAEKFVETHPEFIGIKIIYSDHRSKDVTVIAGSIRTAMGLRTKFPTVVAGFDLVGREDTGHSLHYHNRALMIPAKDGVKLPYFFHAGETDWQGTSIDKNILDALMLNTTRIGHGFALNKHPALRAYSRKKDVPVEVCPISNQVLKLVSDLRNHPAATLMATGHPMVISSDDPAIFGAKGLSYDFYEVFMGIGGMKADLRTLKQLAINSIKYSSLLETEKNTFMAVWKKRWDKFIAHVATD

SEQ ID NO: 376 - protein, 511 aa, Homo sapiens
  Dendritic cell derived growth factor (DCDGF)
  SIGNAL (1)...(29)
  ref <310>: PATENT DOCUMENT NUMBER: US 5968780
  ref <311>: PATENT FILING DATE: 1998-02-05
  ref <312>: PUBLICATION DATE: 1999-10-19
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTSMEIWKKRWDKFIADVATK

SEQ ID NO: 377 - protein, 511 aa, Homo sapiens [sequence omitted]

SEQ ID NO: 378 - protein, 511 aa, Homo sapiens [sequence omitted]

SEQ ID NO: 379 - protein, 511 aa, Homo sapiens
  ADA2 (CECR1)
  SIGNAL (1)...(29)
  ref <308>: DATABASE ACCESSION NUMBER: GenBank: AAH51755.1
  ref <309>: DATABASE ENTRY DATE: 2006-07-15
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPALRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 380 - protein, 482 aa, Homo sapiens
  Dendritic cell derived growth factor (DCDGF) mature form
  ref <310>: PATENT DOCUMENT NUMBER: US 5968780
  ref <311>: PATENT FILING DATE: 1998-02-05
  ref <312>: PUBLICATION DATE: 1999-10-19
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTSMEIWKKRWDKFIADVATK

SEQ ID NO: 381 - protein, 482 aa, Homo sapiens
  ADA2 (CECR1) mature form
  ref <308>: DATABASE ACCESSION NUMBER: GenBank: BAG36969.1
  ref <309>: DATABASE ENTRY DATE: 2008-05-24
IDETRARLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFARPTPRPSEKCSKWILLEDYRRRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 382 - protein, 482 aa, Homo sapiens
  ADA2 (CECR1) mature form
  ref <308>: DATABASE ACCESSION NUMBER: GenBank: AAF65941.1
  ref <309>: DATABASE ENTRY DATE: 2000-04-27
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLRDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 383 - protein, 482 aa, Homo sapiens
  ADA2 (CECR1) mature form
  ref <308>: DATABASE ACCESSION NUMBER: GenBank: AAH51755.1
  ref <309>: DATABASE ENTRY DATE: 2006-07-15
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPALRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 384 - DNA, 40 bp, Artificial Sequence
  CTLA-4 binding aptamer M9a-8
accacagcctttatccaagcgggtgagccccgtgaacaat

SEQ ID NO: 385 - DNA, 40 bp, Artificial Sequence
  CTLA-4 binding aptamer M9a-9
ccgacgtgccgcaacttcaaccctgcacaaccaatccgcc

SEQ ID NO: 386 - DNA, 40 bp, Artificial Sequence
  CTLA-4 binding aptamer M9a-14
caacgaaaggtgctccactaagaatggaacttctgcgatc

SEQ ID NO: 387 - DNA, 40 bp, Artificial Sequence
  CTLA-4 binding aptamer M9a-15
gtgctcaatcacgaacccgctcgacttcttctcccaagcc

SEQ ID NO: 388 - DNA, 40 bp, Artificial Sequence
  CTLA-4 binding aptamer M9a-18
tgctccaacactcacttcggaaccacctgcattccgctct

SEQ ID NO: 389 - DNA, 355 bp, Artificial Sequence
  Ipilimumab heavy chain varible domain (VH)
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaaacaataaatactacgcagactccgtgaagggccgattcaccatctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 390 - protein, 118 aa, Artificial Sequence
  Ipilimumab heavy chain varible domain (VH)
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 391 - DNA, 325 bp, Artificial Sequence
  Ipilimumab light chain varible domain (VH)
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 392 - protein, 108 aa, Artificial Sequence
  Ipilimumab light chain varible domain (VH)
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 393 - protein, 5 aa, Artificial Sequence
  Ipilimumab VH CDR1
SYTMH

SEQ ID NO: 394 - protein, 17 aa, Artificial Sequence
  Ipilimumab VH CDR2
FISYDGNNKYYADSVKG

SEQ ID NO: 395 - protein, 9 aa, Artificial Sequence
  Ipilimumab VH CDR3
TGWLGPFDY

SEQ ID NO: 396 - protein, 12 aa, Artificial Sequence
  Ipilimumab VL CDR1
RASQSVGSSYLA

SEQ ID NO: 397 - protein, 7 aa, Artificial Sequence
  Ipilimumab VL CDR2
GAFSRAT

SEQ ID NO: 398 - protein, 9 aa, Artificial Sequence
  Ipilimumab VL CDR3
QQYGSSPWT

SEQ ID NO: 399 - DNA, 500 bp, Artificial Sequence
  Tremelimumab heavy chain varible domain (VH)
ggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgaggggagctaccctttactactactactacgggatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgca

SEQ ID NO: 400 - protein, 167 aa, Artificial Sequence
  Tremelimumab heavy chain varible domain (VH)
GVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVH

SEQ ID NO: 401 - DNA, 417 bp, Artificial Sequence
  Tremelimumab light chain varible domain (VH)
ccatcctccctgtctgcatctgtaggagacagagtcaccatcacttgccgggcaagtcagagcattaacagctatttagattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagtattacagtactccattcactttcggccctgggaccaaagtggaaatcaaacgaactgtggctgcaccatctgtcttcatcttcccgccatctgatgagcagttgaaatctggaactgcctctgttgtgtgcctgctgaataacttctatcccagagaggccaaagta

SEQ ID NO: 402 - protein, 139 aa, Artificial Sequence
  Tremelimumab light chain varible domain (VH)
PSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKV

SEQ ID NO: 403 - DNA, 339 bp, Artificial Sequence
  Nivolumab heavy chain variable region
caggtgcagctggtggagtctgggggaggcgtggtccagcctgggaggtccctgagactcgactgtaaagcgtctggaatcaccttcagtaactctggcatgcactgggtccgccaggctccaggcaaggggctggagtgggtggcagttatttggtatgatggaagtaaaagatactatgcagactccgtgaagggccgattcaccatctccagagacaattccaagaacacgctgtttctgcaaatgaacagcctgagagccgaggacacggctgtgtattactgtgcgacaaacgacgactactggggccagggaaccctggtcaccgtctcctca

SEQ ID NO: 404 - protein, 113 aa, Artificial Sequence [sequence omitted]

SEQ ID NO: 405 - DNA, 321 bp, Artificial Sequence
  Nivolumab light chain variable region
gaaattgtgttgacacagtctccagccaccctgtctttgtctccaggggaaagagccaccctctcctgcagggccagtcagagtgttagtagttacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagtagcaactggcctcggacgttcggccaagggaccaaggtggaaatcaaa

SEQ ID NO: 406 - protein, 107 aa, Artificial Sequence [sequence omitted]

SEQ ID NO: 407 - protein, 5 aa, Artificial Sequence
  Nivolumab VH CDR1
NSGMH

SEQ ID NO: 408 - protein, 17 aa, Artificial Sequence
  Nivolumab VH CDR2
VIWYDGSKRYYADSVKG

SEQ ID NO: 409 - protein, 4 aa, Artificial Sequence
  Nivolumab VH CDR3
NDDY

SEQ ID NO: 410 - protein, 11 aa, Artificial Sequence
  Nivolumab VL CDR1
RASQSVSSYLA

SEQ ID NO: 411 - protein, 7 aa, Artificial Sequence
  Nivolumab VL CDR2
DASNRAT

SEQ ID NO: 412 - protein, 9 aa, Artificial Sequence
  Nivolumab VL CDR3
QQSSNWPRT

SEQ ID NO: 413 - DNA, 1340 bp, Artificial Sequence
  MK-3475 full-length heavy chain
aggtgcagctggtgcagtccggcgtggaggtgaagaagcctggcgcctccgtcaaggtgtcctgtaaggcctccggctacaccttcaccaactactacatgtactgggtgcggcaggccccaggccagggactggagtggatgggcggcatcaacccttccaacggcggcaccaacttcaacgagaagttcaagaaccgggtgaccctgaccaccgactcctccaccacaaccgcctacatggaactgaagtccctgcagttcgacgacaccgccgtgtactactgcgccaggcgggactaccggttcgacatgggcttcgactactggggccagggcaccaccgtgaccgtgtcctccgctagcaccaagggcccttccgtgttccctctggccccttgctcccggtccacctccgagtccaccgccgctctgggctgtctggtgaaggactacttccctgagcctgtgaccgtgagctggaactctggcgccctgacctccggcgtgcacaccttccctgccgtgctgcagtcctccggcctgtactccctgtcctccgtggtgaccgtgccttcctcctccctgggcaccaagacctacacctgcaacgtggaccacaagccttccaacaccaaggtggacaagcgggtggagtccaagtacggccctccttgccctccctgccctgcccctgagttcctgggcggaccctccgtgttcctgttccctcctaagcctaaggacaccctgatgatctcccggacccctgaggtgacctgcgtggtggtggacgtgtcccaggaagatcctgaggtccagttcaattggtacgtggatggcgtggaggtgcacaacgccaagaccaagcctcgggaggaacagttcaactccacctaccgggtggtgtctgtgctgaccgtgctgcaccaggactggctgaacggcaaggaatacaagtgcaaggtcagcaacaagggcctgccctcctccatcgagaaaaccatctccaaggccaagggccagcctcgcgagcctcaggtgtacaccctgcctcctagccaggaagagatgaccaagaatcaggtgtccctgacatgcctggtgaagggcttctacccttccgatatcgccgtggagtgggagagcaacggccagccagagaacaactacaagaccacccctcctgtgctggactccgacggctccttcttcctgtactccaggctgaccgtggacaagtcccggtggcaggaaggcaacgtcttttcctgctccgtgatgcacgaggccctgcacaaccactacacccagaagtccctgtccctgtctctgggcaag

SEQ ID NO: 414 - protein, 447 aa, Artificial Sequence
  MK-3475 full-length heavy chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 415 - DNA, 334 bp, Artificial Sequence
  MK-3475 full-length light chain
cgagatcgtgctgacccagtcccctgccaccctgtccctgagccctggcgagcgggctaccctgagctgcagagcctccaagggcgtgtccacctccggctactcctacctgcactggtatcagcagaagccaggccaggcccctcggctgctgatctacctggcctcctacctggagtccggcgtgcctgcccggttctccggctccggaagcggcaccgacttcaccctgaccatctcctccctggagcctgaggacttcgccgtgtactactgccagcactcccgggacctgcctctgacctttggcggcggaacaaaggtggagatcaag

SEQ ID NO: 416 - protein, 218 aa, Artificial Sequence
  MK-3475 full-length light chain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - DNA, 361 bp, Artificial Sequence
  MK-3475 heavy chain variable domain
ccaggtgcagctggtgcagtccggcgtggaggtgaagaagcctggcgcctccgtcaaggtgtcctgcaaggcctccggctacaccttcaccaactactacatgtactgggtgcggcaggctcccggccagggactggagtggatgggcggcatcaacccttccaacggcggcaccaacttcaacgagaagttcaagaaccgggtgaccctgaccaccgactcctccaccaccaccgcctacatggagctgaagtccctgcagttcgacgacaccgccgtgtactactgcgccaggcgggactaccggttcgacatgggcttcgactactggggccagggcaccaccgtgaccgtgtcctcc

SEQ ID NO: 418 - protein, 120 aa, Artificial Sequence [sequence omitted]

SEQ ID NO: 419 - DNA, 333 bp, Artificial Sequence
  MK-3475 light chain variable domain
gaaattgtgttgacacagtctccagccaccctgtctttgtctccaggggaaagagccaccctctcctgcagggccagcaaaggtgtcagtacatctggctatagttatttgcactggtatcaacagaaacctggccaggctcccaggctcctcatctatcttgcatcctacctagaatctggcgtcccagccaggttcagtggtagtgggtctgggacagacttcactctcaccatcagcagcctagagcctgaagattttgcagtttattactgtcagcacagcagggaccttccgctcacgttcggcggagggaccaaagtggagatcaaa

SEQ ID NO: 420 - protein, 111 aa, Artificial Sequence [sequence omitted]

SEQ ID NO: 421 - protein, 5 aa, Artificial Sequence
  MK-3475 VH CDR1
NYYMY

SEQ ID NO: 422 - protein, 17 aa, Artificial Sequence
  MK-3475 VH CDR2
GINPSNGGTNFNEKFKN

SEQ ID NO: 423 - protein, 11 aa, Artificial Sequence
  MK-3475 VH CDR3
RDYRFDMGFDY

SEQ ID NO: 424 - protein, 15 aa, Artificial Sequence
  MK-3475 VL CDR1
RASKGVSTSGYSYLH

SEQ ID NO: 425 - protein, 7 aa, Artificial Sequence
  MK-3475 VL CDR2
LASYLES

SEQ ID NO: 426 - protein, 9 aa, Artificial Sequence
  MK-3475 VL CDR3
QHSRDLPLT

SEQ ID NO: 427 - DNA, 1401 bp, Artificial Sequence
  Pidilizumab full-length heavy chain
atggactggacctggaggatcctcttcttggtggcagcagcaacaggtgcccactcccaggtgcagctggtgcaatctgggtctgagcttaagaagcctggggcctcagtgaagatctcctgcaaggcttctggatatactttcacaaactatggaatgaactgggtgcgacaggcccctggacaagggcttcagtggatgggatggataaacaccgacagtggagagtcaacatatgctgaagagttcaagggacggtttgtcttctccttggacacctctgtcaacacggcatatctgcagatcaccagcctcacggctgaggacactggcatgtatttctgtgtgagagtcggctacgatgctttggactactggggccagggaaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 428 - protein, 466 aa, Artificial Sequence
  Pidilizumab full-length heavy chain
MDWTWRILFLVAAATGAHSQVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - DNA, 708 bp, Artificial Sequence
  Pidilizumab full-length light chain
atggacatgagggtccccgctcagctcctggggctcctgctgctctggctcccaggtgccaaatgtgaaattgtgttgacgcagtctccatcctccctgtctgcatctgtaggagacagagtcaccatcacttgcagtgccaggtcaagtgtaagttacatgcactggttccagcagaaaccagggaaagcccctaagctctggatctataggacatccaacctggcttctggggtcccatctagattcagcggcagtggatctgggacatcttactgtctcaccatcaacagcctgcagcctgaagattttgcaacttactattgccagcaaaggagtagtttcccactcacgttcggcggagggaccaagctggagatcaaacgtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 430 - protein, 235 aa, Artificial Sequence
  Pidilizumab full-length light chain
MDMRVPAQLLGLLLLWLPGAKCEIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 431 - DNA, 421 bp, Artificial Sequence
  Pidilizumab heavy chain variable domain
atggactggacctggaggatcctcttcttggtggcagcagcaacaggtgcccactcccaggtgcagctggtgcaatctgggtctgagcttaagaagcctggggcctcagtgaagatctcctgcaaggcttctggatatactttcacaaactatggaatgaactgggtgcgacaggcccctggacaagggcttcagtggatgggatggataaacaccgacagtggagagtcaacatatgctgaagagttcaagggacggtttgtcttctccttggacacctctgtcaacacggcatatctgcagatcaccagcctcacggctgaggacactggcatgtatttctgtgtgagagtcggctacgatgctttggactactggggccagggaaccctggtcaccgtctcctcaggtgagtggatcc

SEQ ID NO: 432 - protein, 117 aa, Artificial Sequence
  Pidilizumab heavy chain variable domain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 433 - DNA, 384 bp, Artificial Sequence
  Pidilizumab light chain variable domain
atggacatgagggtccccgctcagctcctggggctcctgctgctctggctcccaggtgccaaatgtgaaattgtgttgacgcagtctccatcctccctgtctgcatctgtaggagacagagtcaccatcacttgcagtgccaggtcaagtgtaagttacatgcactggttccagcagaaaccagggaaagcccctaagctctggatctataggacatccaacctggcttctggggtcccatctagattcagcggcagtggatctgggacatcttactgtctcaccatcaacagcctgcagcctgaagattttgcaacttactattgccagcaaaggagtagtttcccactcacgttcggcggagggaccaagctggagatcaaa

SEQ ID NO: 434 - protein, 106 aa, Artificial Sequence
  Pidilizumab light chain variable domain
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 435 - protein, 5 aa, Artificial Sequence
  Pidilizumab VH CDR1
NYGMN

SEQ ID NO: 436 - protein, 17 aa, Artificial Sequence
  Pidilizumab VH CDR2
WINTDSGESTYAEEFKG

SEQ ID NO: 437 - protein, 8 aa, Artificial Sequence
  Pidilizumab VH CDR3
VGYDALDY

SEQ ID NO: 438 - protein, 10 aa, Artificial Sequence
  Pidilizumab VL CDR1
SARSSVSYMH

SEQ ID NO: 439 - protein, 7 aa, Artificial Sequence
  Pidilizumab VL CDR2
RTSNLAS

SEQ ID NO: 440 - protein, 9 aa, Artificial Sequence
  Pidilizumab VL CDR3
QQRSSFPLT

SEQ ID NO: 441 - DNA, 369 bp, Artificial Sequence
  BMS-936559 heavy chain variable region
caggtccagctggtgcagtctggggctgaggtgaagaagcctgggtcctcggtgaaggtctcctgcaagacttctggagacaccttcagcacctatgctatcagctgggtgcgacaggcccctggacaagggcttgagtggatgggagggatcatccctatatttggtaaagcacactacgcacagaagttccagggcagagtcacgattaccgcggacgaatccacgagcacagcctacatggagctgagcagcctgagatctgaggacacggccgtgtatttttgtgcgagaaagtttcactttgtttcggggagccccttcggtatggacgtctggggccaagggaccacggtcaccgtctcctca

SEQ ID NO: 442 - protein, 123 aa, Artificial Sequence
  BMS-936559 heavy chain variable region
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 443 - DNA, 318 bp, Artificial Sequence
  BMS-936559 light chain variable region
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgacgttcggccaagggaccaaggtggaaatcaaa

SEQ ID NO: 444 - protein, 106 aa, Artificial Sequence
  BMS-936559 light chain variable region
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 445 - protein, 6 aa, Artificial Sequence
  BMS-936559 VH CDR1
TYAISW

SEQ ID NO: 446 - protein, 17 aa, Artificial Sequence
  BMS-936559 VH CDR2
GIIPIFGKAHYAQKFQG

SEQ ID NO: 447 - protein, 14 aa, Artificial Sequence
  BMS-936559 VH CDR3
KFHFVSGSPFGMDV

SEQ ID NO: 448 - protein, 11 aa, Artificial Sequence
  BMS-936559 VL CDR1
RASQSVSSYLA

SEQ ID NO: 449 - protein, 7 aa, Artificial Sequence
  BMS-936559 VL CDR2
DASNRAT

SEQ ID NO: 450 - protein, 8 aa, Artificial Sequence
  BMS-936559 VL CDR3
QQRSNWPT

SEQ ID NO: 451 - DNA, 360 bp, Artificial Sequence
  MEDI4736 heavy chain variable region
gaggtgcagctggtcgagtctggcggcggactggtgaagcctggcggctccctgagactgtcttgcgccgccagtggctttacattcagtacctactccatgaactgggtccgccaggcaccaggcaagggcctggaatgggtgtcctccatctcatccagtggcgactacatctactacgccgactccgtgaagggccggttcaccatctcccgggacaacgccaagaactccctgtatctgcagatgaactccctgagagccgaggacaccgccgtgtactactgcgccagggacctggtgacatccatggtggccttcgactactggggtcagggcactctcgtcacagtgtcctct

SEQ ID NO: 452 - protein, 120 aa, Artificial Sequence
  MEDI4736 heavy chain variable region
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 453 - DNA, 324 bp, Artificial Sequence
  MEDI4736 light chain variable region
tcttacgagctgacccagcctccttccgtgtccgtgtctccaggacagacggccagaatcacctgttccggcgacgccctgcctcagaaatacgtgttctggtatcagcagaagtccggccaggcccctgtgctggtgatctacgaggactccaagcggccttccggcatccctgagcggttctccggctcctcttccggcaccatggccaccctgaccatctctggcgcccaggtggaggacgaggccgactactactgctactccaccgacagatccggcaaccacagagtgtttggtgggggtactaagctgaccgtgctg

SEQ ID NO: 454 - protein, 108 aa, Artificial Sequence
  MEDI4736 light chain variable region
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 455 - protein, 5 aa, Artificial Sequence
  MEDI4736 VH CDR1
TYSMN

SEQ ID NO: 456 - protein, 17 aa, Artificial Sequence
  MEDI4736 VH CDR2
SISSSGDYIYYADSVKG

SEQ ID NO: 457 - protein, 11 aa, Artificial Sequence
  MEDI4736 VH CDR3
DLVTSMVAFDY

SEQ ID NO: 458 - protein, 11 aa, Artificial Sequence
  MEDI4736 VL CDR1
SGDALPQKYVF

SEQ ID NO: 459 - protein, 7 aa, Artificial Sequence
  MEDI4736 VL CDR2
EDSKRPS

SEQ ID NO: 460 - protein, 11 aa, Artificial Sequence
  MEDI4736 VL CDR3
YSTDRSGNHRV

SEQ ID NO: 461 - protein, 433 aa, Artificial Sequence
  MPDL3280A heavy chain full length
EVQLVESGGGLVQPGGSLRLSCAASGFTFSDSWIHWYRQAPGKGLEWYAWISPYGGSTYYADSVKGRFTISADTSKNTAYLQMNSLRAEDTAVYYCARRHWPGGFDYWGQGTLVTVSSASTGPSVFPLAPSSKSTSGGTAALGCLVKDYFPEPVTVSWNSGALTSGVHTFPAVLQSSGLYSLSSVVTVPSSSLGTQTYICNVNHPSNTKVDKKVEPKSCDTHTCPPCPAPELLGGPSVFLFPPPDTLMISRTPEVTCWVDVSHEDPEVKFNWYVDGVEVHNATKPREEQYASTYRVVSVLTVLHQDWLNGKEYKCVSNALPAPIETISKAGQPREPQVYTLPPSREEMTNQVSLTCLVGFYPSDAVEWESNGQPENNYTTPPVLDSDGSFFLYSKLTVDKSRWQQGNVFSCSVMHEALHNHYTQKSLSLSPGK

SEQ ID NO: 462 - protein, 212 aa, Artificial Sequence
  MPDL3280A light chain full length
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 118 aa, Artificial Sequence
  MPDL3280A heavy chain variable region
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 464 - protein, 108 aa, Artificial Sequence
  MPDL3280A light chain variable region
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 465 - protein, 10 aa, Artificial Sequence
  MPDL3280A VH CDR1
GFTFSDSWIH

SEQ ID NO: 466 - protein, 18 aa, Artificial Sequence
  MPDL3280A VH CDR2
AWISPYGGSTYYADSVKG

SEQ ID NO: 467 - protein, 9 aa, Artificial Sequence
  MPDL3280A VH CDR3
RHWPGGFDY

SEQ ID NO: 468 - protein, 11 aa, Artificial Sequence
  MPDL3280A LH CDR1
RASQDVSTAVA

SEQ ID NO: 469 - protein, 7 aa, Artificial Sequence
  MPDL3280A LH CDR2
SASFLYS

SEQ ID NO: 470 - protein, 9 aa, Artificial Sequence
  MPDL3280A LH CDR3
QQYLYHPAT

SEQ ID NO: 471 - protein, 10 aa, Artificial Sequence
  Tremelimumab VH CDR1
GFTFSSYGMH

SEQ ID NO: 472 - protein, 15 aa, Artificial Sequence
  Tremelimumab VH CDR2
VIWYDGSNKYYADSV

SEQ ID NO: 473 - protein, 16 aa, Artificial Sequence
  Tremelimumab VH CDR3
DPRGATLYYYYYGMDV

SEQ ID NO: 474 - protein, 11 aa, Artificial Sequence
  Tremelimumab VL CDR1
RASQSINSYLD

SEQ ID NO: 475 - protein, 7 aa, Artificial Sequence
  Tremelimumab VL CDR2
AASSLQS

SEQ ID NO: 476 - protein, 9 aa, Artificial Sequence
  Tremelimumab VL CDR3
QQYYSTPFT

SEQ ID NO: 477 - protein, 434 aa, Artificial Sequence
  anti-PD-L1 antibody heavy chain
EVQLVESGGGLVQPGGSLRLSCAASGFTFSDSWIHWYRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHPSNTKVDKKVEPKSCDTHTCPPCPAPELLGGPSVFLFPPPDTLMISRTPEVTCWVDVSHEDPEVKFNWYVDGVEVHNATKPREEQYASTYRVVSVLTVLHQDWLNGKEYKCVSNALPAPIETISKAGQPREPQVYTLPPSREEMTNQVSLTCLVGFYPSDAVEWESNGQPENNYTTPPVLDSDGSFFLYSKLTVDKSRWQQGNVFSCSVMHEALHNHYTQKSLSLSPGK

SEQ ID NO: 478 - protein, 213 aa, Artificial Sequence
  anti-PD-L1 antibody light chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - protein, 434 aa, Artificial Sequence
  anti-PD-L1 antibody heavy chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHPSNTKVDKKVEPKSCDTHTCPPCPAPELLGGPSVFLFPPPDTLMISRTPEVTCWVDVSHEDPEVKFNWYVDGVEVHNATKPREEQYASTYRVVSVLTVLHQDWLNGKEYKCVSNALPAPIETISKAGQPREPQVYTLPPSREEMTNQVSLTCLVGFYPSDAVEWESNGQPENNYTTPPVLDSDGSFFLYSKLTVDKSRWQQGNVFSCSVMHEALHNHYTQKSLSLSPGK

SEQ ID NO: 480 - protein, 474 aa, Homo sapiens
  mature human PH20, amino acid residues 36-509
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 481 - protein, 447 aa, Homo sapiens [sequence omitted]

SEQ ID NO: 482 - protein, 446 aa, Homo sapiens
  mature soluble human PH20, amino acid residues 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 483 - protein, 445 aa, Homo sapiens
  mature soluble human PH20, amino acid residues 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 484 - protein, 444 aa, Homo sapiens
  mature soluble human PH20, amino acid residues 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 485 - protein, 443 aa, Homo sapiens
  mature soluble human PH20, amino acid residues 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 486 - protein, 442 aa, Homo sapiens
  mature soluble human PH20, amino acid residues 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 487 - protein, 432 aa, Homo sapiens
  mature soluble human PH20, amino acid residues 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 488 - protein, 448 aa, Homo sapiens
  mature soluble human PH20, amino acid residues 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 489 - protein, 472 aa, Homo sapiens
  mature soluble human PH20, amino acid residues 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 490 - protein, 470 aa, Homo sapiens
  mature soluble human PH20, amino acid residues 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 491 - protein, 468 aa, Homo sapiens
  mature soluble human PH20, amino acid residues 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 492 - protein, 466 aa, Homo sapiens
  mature soluble human PH20, amino acid residues 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 493 - protein, 464 aa, Homo sapiens
  mature soluble human PH20, amino acid residues 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 494 - protein, 462 aa, Homo sapiens
  mature soluble human PH20, amino acid residues 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 495 - protein, 460 aa, Homo sapiens
  mature soluble human PH20, amino acid residues 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 496 - protein, 458 aa, Homo sapiens
  mature soluble human PH20, amino acid residues 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 497 - protein, 456 aa, Homo sapiens
  mature soluble human PH20, amino acid residues 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 498 - protein, 454 aa, Homo sapiens
  mature soluble human PH20, amino acid residues 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 499 - protein, 455 aa, Homo sapiens
  mature soluble human PH20, amino acid residues 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 500 - protein, 452 aa, Homo sapiens
  mature soluble human PH20, amino acid residues 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 501 - protein, 450 aa, Homo sapiens
  mature soluble human PH20, amino acid residues 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 502 - protein, 449 aa, Homo sapiens
  mature soluble human PH20, amino acid residues 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 503 - protein, 441 aa, Homo sapiens
  mature soluble human PH20, amino acid residues 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 504 - protein, 440 aa, Homo sapiens
  mature soluble human PH20, amino acid residues 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 505 - protein, 439 aa, Homo sapiens
  mature soluble human PH20, amino acid residues 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 506 - protein, 438 aa, Homo sapiens
  mature soluble human PH20, amino acid residues 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 507 - protein, 437 aa, Homo sapiens
  mature soluble human PH20, amino acid residues 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 508 - protein, 436 aa, Homo sapiens
  mature soluble human PH20, amino acid residues 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 509 - protein, 435 aa, Homo sapiens
  mature soluble human PH20, amino acid residues 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 510 - protein, 434 aa, Homo sapiens
  mature soluble human PH20, amino acid residues 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 511 - protein, 433 aa, Homo sapiens
  mature soluble human PH20, amino acid residues 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 512 - protein, 431 aa, Homo sapiens
  mature soluble human PH20, amino acid residues 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 513 - protein, 430 aa, Homo sapiens
  mature soluble human PH20, amino acid residues 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 514 - protein, 429 aa, Homo sapiens
  mature soluble human PH20, amino acid residues 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 515 - protein, 427 aa, Homo sapiens
  mature soluble human PH20, amino acid residues 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 516 - protein, 425 aa, Homo sapiens
  mature soluble human PH20, amino acid residues 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 517 - protein, 423 aa, Homo sapiens
  mature soluble human PH20, amino acid residues 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 518 - protein, 421 aa, Homo sapiens
  mature soluble human PH20, amino acid residues 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 519 - protein, 419 aa, Homo sapiens
  mature soluble human PH20, amino acid residues 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 520 - protein, 417 aa, Homo sapiens
  mature soluble human PH20, amino acid residues 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 521 - protein, 415 aa, Homo sapiens
  mature soluble human PH20, amino acid residues 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 522 - protein, 473 aa, Homo sapiens
  mature soluble human PH20, amino acid residues 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 523 - protein, 471 aa, Homo sapiens
  mature soluble human PH20, amino acid residues 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 524 - protein, 469 aa, Homo sapiens
  mature soluble human PH20, amino acid residues 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 525 - protein, 467 aa, Homo sapiens
  mature soluble human PH20, amino acid residues 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 526 - protein, 465 aa, Homo sapiens
  mature soluble human PH20, amino acid residues 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 527 - protein, 463 aa, Homo sapiens
  mature soluble human PH20, amino acid residues 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 528 - protein, 461 aa, Homo sapiens
  mature soluble human PH20, amino acid residues 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 529 - protein, 459 aa, Homo sapiens
  mature soluble human PH20, amino acid residues 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 530 - protein, 457 aa, Homo sapiens
  mature soluble human PH20, amino acid residues 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 531 - protein, 453 aa, Homo sapiens
  mature soluble human PH20, amino acid residues 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 532 - protein, 451 aa, Homo sapiens
  mature soluble human PH20, amino acid residues 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 533 - protein, 326 aa, Homo sapiens
  adenosine receptor A1
  ref <308>: DATABASE ACCESSION NUMBER: NCBI: NP_000665.1
  ref <309>: DATABASE ENTRY DATE: 2014-04-06
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 534 - protein, 412 aa, Homo sapiens
  adenosine receptor A2a
  ref <308>: DATABASE ACCESSION NUMBER: NCBI: NP_000666.2
  ref <309>: DATABASE ENTRY DATE: 2014-05-26
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 535 - protein, 332 aa, Homo sapiens
  adenosine receptor A2b
  ref <308>: DATABASE ACCESSION NUMBER: NCBI: NP_000667.1
  ref <309>: DATABASE ENTRY DATE: 2014-05-30
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 536 - protein, 347 aa, Homo sapiens
  adenosine receptor A3 isoform 1
  ref <308>: DATABASE ACCESSION NUMBER: NCBI: NP_065734.5
  ref <309>: DATABASE ENTRY DATE: 2014-04-20
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 537 - protein, 318 aa, Homo sapiens
  adenosine receptor A3 isoform 2
  ref <308>: DATABASE ACCESSION NUMBER: NCBI: NP_000668.1
  ref <309>: DATABASE ENTRY DATE: 2014-05-03
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 538 - protein, 266 aa, Homo sapiens
  adenosine receptor A3 isoform 3
  ref <308>: DATABASE ACCESSION NUMBER: NCBI: NP_001075445.1
  ref <309>: DATABASE ENTRY DATE: 2014-04-20
MEGSPAGPIEQKEARWESSWEEQPDWTLGCLSPESQFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 539 - DNA, 123 bp, Artificial Sequence
  CTLA-4 binding aptamer M9a-1
gggggaattctaatacgactcactatagggagagaggaagagggataggccgcccgagtacaaacgtactcgcctgtttgcccaaccgacataacccagaggtcgatagtacyggatcccccc

SEQ ID NO: 540 - DNA, 40 bp, Artificial Sequence
  CTLA-4 binding aptamer M9a-4
cagccaaaggatatccaagcggcacgccataacacaacac

SEQ ID NO: 541 - DNA, 41 bp, Artificial Sequence
  CTLA-4 binding aptamer M9a-5
caccggaagggctacactcctatatcccctgcccagcccgc

SEQ ID NO: 542 - protein, 510 aa, Homo sapiens
  ectonucleoside triphosphate diphosphohydrolase (CD39) 1 isoform 1
  ref <308>: DATABASE ACCESSION NUMBER: NCBI: NP_001767.3
  ref <309>: DATABASE ENTRY DATE: 2014-04-16
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 543 - protein, 574 aa, Homo sapiens
  5'-ectonucleotidase (CD73) isoform 1 preproprotein
  SIGNAL (1)...(26)
  ref <308>: DATABASE ACCESSION NUMBER: NCBI: NP_002517.1
  ref <309>: DATABASE ENTRY DATE: 2014-05-03
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 544 - protein, 223 aa, Homo sapiens
  CTLA4
  ref <308>: DATABASE ACCESSION NUMBER: GenBank: AAL07473.1
  ref <309>: DATABASE ENTRY DATE: 2001-09-26
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 545 - protein, 288 aa, Homo sapiens
  Programmed cell death protein 1
  SIGNAL (1)...(20)
  ref <308>: DATABASE ACCESSION NUMBER: Uniprot Q15116.3
  ref <309>: DATABASE ENTRY DATE: 2014-10-01
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 546 - protein, 290 aa, Homo sapiens
  Programmed cell death 1 ligand 1
  SIGNAL (1)...(18)
  ref <308>: DATABASE ACCESSION NUMBER: Uniprot Q9NZQ7.1
  ref <309>: DATABASE ENTRY DATE: 2014-10-01
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 547 - DNA, 1536 bp, Homo sapiens
  ADA2 (CECR1)
  ref <308>: DATABASE ACCESSION NUMBER: ENA: CAG30303.1
  ref <309>: DATABASE ENTRY DATE: 2008-10-16
atgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtga

SEQ ID NO: 548 - protein, 423 aa, Artificial Sequence
  human ADA2 N98-N156Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 549 - protein, 438 aa, Artificial Sequence
  human ADA2 C105-E148Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 550 - protein, 439 aa, Artificial Sequence
  human ADA2 C105-T147Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 551 - protein, 509 aa, Homo sapiens
  human (PH20 precursor) (1-509)
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 552 - protein, 482 aa, Artificial Sequence
  human ADA2 R125N/P126A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPNASEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 553 - protein, 482 aa, Artificial Sequence
  human ADA2 S127N/K129S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPNESCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 554 - protein, 482 aa, Artificial Sequence
  human ADA2 P126N/E128T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRNSTKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 555 - protein, 482 aa, Artificial Sequence
  human ADA2 R112N/I114T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPNGTMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 556 - protein, 482 aa, Artificial Sequence
  human ADA2 I134N/L135C/L136T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWNCTEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 557 - protein, 482 aa, Artificial Sequence
  human ADA2 I134N/L135S/L136T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWNSTEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 558 - protein, 482 aa, Artificial Sequence
  human ADA2 R142N/Q144S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKNVSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 559 - protein, 482 aa, Artificial Sequence
  human ADA2 E137N/Y139T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLNDTRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 560 - protein, 482 aa, Artificial Sequence
  human ADA2 P111N/G113S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTNRSIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 561 - protein, 482 aa, Artificial Sequence
  human ADA2 F119S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRSAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 562 - protein, 482 aa, Artificial Sequence
  human ADA2 F119K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRKAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 563 - protein, 482 aa, Artificial Sequence
  human ADA2 Y224R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVRELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 564 - protein, 482 aa, Artificial Sequence
  human ADA2 Y224N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVNELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 565 - protein, 482 aa, Artificial Sequence
  human ADA2 Y191S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHSAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 566 - protein, 482 aa, Artificial Sequence
  human ADA2 Y191D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHDAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 567 - protein, 482 aa, Artificial Sequence
  human ADA2 F183K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFKTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 568 - protein, 482 aa, Artificial Sequence
  human ADA2 Y191D/Y224R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHDAPVFRDYVFRSMQEFYEDNVLYMEIRARLLPVRELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 569 - protein, 482 aa, Artificial Sequence
  human ADA2 F109S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICSTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 570 - protein, 482 aa, Artificial Sequence
  human ADA2 F109A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICATPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 571 - protein, 482 aa, Artificial Sequence
  human ADA2 R118D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFDFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 572 - protein, 482 aa, Artificial Sequence
  human ADA2 R118A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFAFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 573 - protein, 482 aa, Artificial Sequence
  human ADA2 Y139T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDTRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 574 - protein, 482 aa, Artificial Sequence
  human ADA2 Y139A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDARKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 575 - protein, 482 aa, Artificial Sequence
  human ADA2 W133S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKSILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 576 - protein, 482 aa, Artificial Sequence
  human ADA2 W133T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKTILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 577 - protein, 482 aa, Artificial Sequence
  human ADA2 P124A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTARPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 578 - protein, 482 aa, Artificial Sequence
  human ADA2 P124S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTSRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 579 - protein, 436 aa, Artificial Sequence
  human ADA2 V99-Q144del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 580 - protein, 10 aa, Artificial Sequence
  linker
GGGGSGGGGS

SEQ ID NO: 581 - protein, 441 aa, Artificial Sequence
  human ADA2 V99-Q144del->(GGGGS)n, mature numbering, where n = 1 to 5
  REPEAT (99)...(103): occurring 1, 2, 3, 4 or 5 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 582 - protein, 444 aa, Artificial Sequence
  human ADA2 C105-T147del->(GGGGS)n, mature numbering, where n = 1 to 5
  REPEAT (105)...(109): occurring 1, 2, 3, 4 or 5 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 583 - protein, 441 aa, Artificial Sequence; identical to SEQ ID NO: 581
  human ADA2 V99-Q144del->(GGGGS)1, mature numbering

SEQ ID NO: 584 - protein, 446 aa, Artificial Sequence
  human ADA2 V99-Q144del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 585 - protein, 451 aa, Artificial Sequence
  human ADA2 V99-Q144del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 586 - protein, 444 aa, Artificial Sequence; identical to SEQ ID NO: 582
  human ADA2 C105-T147del->(GGGGS)1, mature numbering

SEQ ID NO: 587 - protein, 449 aa, Artificial Sequence
  human ADA2 C105-T147del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 588 - protein, 454 aa, Artificial Sequence
  human ADA2 C105-T147del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 589 - protein, 441 aa, Artificial Sequence
  human ADA2 K371D/V99-Q144del->(GGGGS)1, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 590 - protein, 446 aa, Artificial Sequence
  human ADA2 K371D/V99-Q144del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 591 - protein, 451 aa, Artificial Sequence
  human ADA2 K371D/V99-Q144del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 592 - protein, 444 aa, Artificial Sequence
  human ADA2 K371D/C105-T147del->(GGGGS)1, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 593 - protein, 449 aa, Artificial Sequence
  human ADA2 K371D/C105-T147del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 594 - protein, 454 aa, Artificial Sequence
  human ADA2 K371D/C105-T147del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 595 - protein, 6 aa, Artificial Sequence
  Linker Ser(Gly4Ser)n
  REPEAT (2)...(6): occurring 1, 2, 3, 4, 5 or more times
SGGGGS

SEQ ID NO: 596 - protein, 485 aa, Artificial Sequence
  human ADA2 R219Q/S262N/I1insNAS, mature numbering
NASIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 597 - protein, 482 aa, Artificial Sequence
  human ADA2 R219Q/S262N/R20N/V22S, mature numbering
IDETRAHLLLKEKMMRLGGNLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 598 - protein, 482 aa, Artificial Sequence
  human ADA2 R219Q/S262N/K371N/D373S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWNKSIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 599 - protein, 482 aa, Artificial Sequence
  human ADA2 R219Q/S262N/K372N/I374S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKNDSPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 600 - protein, 482 aa, Artificial Sequence
  human ADA2 R219Q/S262N/T403N/H405S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMANGSPMVISSDDPAMFGAKGLSYDFYEVFMGIGGMKADLRTLKQLAMNSIKYSTLLESEKNTFMEIWKKRWDKFIADVATK

SEQ ID NO: 601 - protein, 482 aa, Artificial Sequence
  human ADA2 R219Q/S262N/G404N/P406S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATNHSMVISSDDPAMFGAKGLSYDFYEVFMGIGGMKADLRTLKQLAMNSIKYSTLLESEKNTFMEIWKKRWDKFIADVATK

SEQ ID NO: 602 - protein, 454 aa, Artificial Sequence
  human ADA2 R219Q/S262N/C105-T147del->(Gly)15, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 603 - protein, 449 aa, Artificial Sequence
  human ADA2 R219Q/S262N/C105-T147del->(Gly)10, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 604 - protein, 446 aa, Artificial Sequence
  human ADA2 R219Q/S262N/C105-T147del->(Gly)7, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 605 - protein, 444 aa, Artificial Sequence
  human ADA2 R219Q/S262N/C105-T147del->(Gly)5, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 606 - protein, 442 aa, Artificial Sequence
  human ADA2 R219Q/S262N/C105-T147del->(Gly)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 607 - protein, 482 aa, Artificial Sequence
  human ADA2 R219Q/S262N/R125N/P126A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPNASEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 608 - protein, 482 aa, Artificial Sequence
  human ADA2 R219Q/S262N/S127N/K129S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPNESCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 609 - protein, 482 aa, Artificial Sequence
  human ADA2 R219Q/S262N/P126N/E128T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRNSTKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 610 - protein, 482 aa, Artificial Sequence
  human ADA2 R219Q/S262N/R112N/I114T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPNGTMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 611 - protein, 482 aa, Artificial Sequence
  human ADA2 R219Q/S262N/I134N/L135C/L136T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWNCTEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 612 - protein, 482 aa, Artificial Sequence
  human ADA2 R219Q/S262N/I134N/L135S/L136T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWNSTEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 613 - protein, 482 aa, Artificial Sequence
  human ADA2 R219Q/S262N/R142N/Q144S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKNVSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 614 - protein, 482 aa, Artificial Sequence
  human ADA2 R219Q/S262N/E137N/Y139T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLNDTRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 615 - protein, 482 aa, Artificial Sequence
  human ADA2 R219Q/S262N/P111N/G113S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTNRSIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 616 - protein, 482 aa, Artificial Sequence
  human ADA2 R219Q/S262N/F119S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRSAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 617 - protein, 482 aa, Artificial Sequence
  human ADA2 R219Q/S262N/F119K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRKAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 618 - protein, 482 aa, Artificial Sequence
  human ADA2 R219Q/S262N/Y224R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVRELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 619 - protein, 482 aa, Artificial Sequence
  human ADA2 R219Q/S262N/Y224N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVNELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 620 - protein, 482 aa, Artificial Sequence
  human ADA2 R219Q/S262N/Y191S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHSAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 621 - protein, 482 aa, Artificial Sequence
  human ADA2 R219Q/S262N/Y191D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHDAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 622 - protein, 482 aa, Artificial Sequence
  human ADA2 R219Q/S262N/F183K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFKTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 623 - protein, 482 aa, Artificial Sequence
  human ADA2 R219Q/S262N/Y191D/Y224R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHDAPVFRDYVFRSMQEFYEDNVLYMEIRAQLLPVRELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 624 - protein, 482 aa, Artificial Sequence
  human ADA2 R219Q/S262N/F109S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICSTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 625 - protein, 482 aa, Artificial Sequence
  human ADA2 R219Q/S262N/F109A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICATPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 626 - protein, 482 aa, Artificial Sequence
  human ADA2 R219Q/S262N/R118D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFDFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 627 - protein, 482 aa, Artificial Sequence
  human ADA2 R219Q/S262N/R118A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFAFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 628 - protein, 482 aa, Artificial Sequence
  human ADA2 R219Q/S262N/Y139T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDTRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 629 - protein, 482 aa, Artificial Sequence
  human ADA2 R219Q/S262N/Y139A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDARKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 630 - protein, 482 aa, Artificial Sequence
  human ADA2 R219Q/S262N/W133S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKSILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 631 - protein, 482 aa, Artificial Sequence
  human ADA2 R219Q/S262N/W133T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKTILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 632 - protein, 482 aa, Artificial Sequence
  human ADA2 R219Q/S262N/P124A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTARPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 633 - protein, 482 aa, Artificial Sequence
  human ADA2 R219Q/S262N/P124S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTSRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 634 - protein, 441 aa, Artificial Sequence
  human ADA2 R219Q/S262N/V99-Q144del->(GGGGS)1, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 635 - protein, 446 aa, Artificial Sequence
  human ADA2 R219Q/S262N/V99-Q144del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 636 - protein, 451 aa, Artificial Sequence
  human ADA2 R219Q/S262N/V99-Q144del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 637 - protein, 444 aa, Artificial Sequence
  human ADA2 R219Q/S262N/C105-T147del->(GGGGS)1, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 638 - protein, 449 aa, Artificial Sequence
  human ADA2 R219Q/S262N/C105-T147del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 639 - protein, 454 aa, Artificial Sequence
  human ADA2 R219Q/S262N/C105-T147del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 640 - protein, 441 aa, Artificial Sequence
  human ADA2 R219Q/S262N/K371D/V99-Q144del->(GGGGS)1, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 641 - protein, 446 aa, Artificial Sequence
  human ADA2 R219Q/S262N/K371D/V99-Q144del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 642 - protein, 451 aa, Artificial Sequence
  human ADA2 R219Q/S262N/K371D/V99-Q144del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSGGGGSGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 643 - protein, 444 aa, Artificial Sequence
  human ADA2 R219Q/S262N/K371D/C105-T147del->(GGGGS)1, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 644 - protein, 449 aa, Artificial Sequence
  human ADA2 R219Q/S262N/K371D/C105-T147del->(GGGGS)2, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 645 - protein, 454 aa, Artificial Sequence
  human ADA2 R219Q/S262N/K371D/C105-T147del->(GGGGS)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSGGGGSGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 646 - protein, 440 aa, Artificial Sequence
  human ADA2 K371D/C105-T147del->(Gly)n, mature numbering, where n = 2 to 20
  REPEAT (105)...(105): occurring 2, 3, 4, 5, 6, 7, 8, 9, 10, 11, 12, 13, 14, 15, 16, 17, 18, 19 or 20 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 647 - protein, 454 aa, Artificial Sequence
  human ADA2 K371D/C105-T147del->(Gly)15, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 648 - protein, 449 aa, Artificial Sequence
  human ADA2 K371D/C105-T147del->(Gly)10, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 649 - protein, 446 aa, Artificial Sequence
  human ADA2 K371D/C105-T147del->(Gly)7, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 650 - protein, 444 aa, Artificial Sequence
  human ADA2 K371D/C105-T147del->(Gly)5, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 651 - protein, 442 aa, Artificial Sequence
  human ADA2 K371D/C105-T147del->(Gly)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 652 - protein, 441 aa, Artificial Sequence; identical to SEQ ID NO: 589
  human ADA2 K371D/V99-Q144del->(GGGGS)n, mature numbering, where n = 1 to 5
  REPEAT (99)...(103): occurring 1, 2, 3, 4 or 5 times

SEQ ID NO: 653 - protein, 444 aa, Artificial Sequence; identical to SEQ ID NO: 592
  human ADA2 K371D/C105-T147del->(GGGGS)n, mature numbering, where n = 1 to 5
  REPEAT (105)...(109): occurring 1, 2, 3, 4 or 5 times

SEQ ID NO: 654 - protein, 423 aa, Artificial Sequence
  human ADA2 K371D/N98-N156Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 655 - protein, 438 aa, Artificial Sequence
  human ADA2 K371D/C105-E148Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 656 - protein, 439 aa, Artificial Sequence
  human ADA2 K371D/C105-T147Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 657 - protein, 436 aa, Artificial Sequence
  human ADA2 K371D/V99-Q144del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 658 - protein, 440 aa, Artificial Sequence
  human ADA2 R219Q/S262N/C105-T147del->(Gly)n, mature numbering, where n = 2 to 20
  REPEAT (105)...(105): occurring 2, 3, 4, 5, 6, 7, 8, 9, 10, 11, 12, 13, 14, 15, 16, 17, 18, 19 or 20 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEITKKRWDKFIADVATK

SEQ ID NO: 659 - protein, 482 aa, Artificial Sequence
  human ADA2 R219Q/S262N/K11A, mature numbering
IDETRAHLLLAEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 660 - protein, 482 aa, Artificial Sequence
  human ADA2 R219Q/S262N/K11D, mature numbering
IDETRAHLLLDEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 661 - protein, 482 aa, Artificial Sequence
  human ADA2 R219Q/S262N/K11E, mature numbering
IDETRAHLLLEEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 662 - protein, 482 aa, Artificial Sequence
  human ADA2 R219Q/S262N/K13A, mature numbering
IDETRAHLLLKEAMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 663 - protein, 482 aa, Artificial Sequence
  human ADA2 R219Q/S262N/K13D, mature numbering
IDETRAHLLLKEDMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 664 - protein, 441 aa, Artificial Sequence; identical to SEQ ID NO: 634
  human ADA2 R219Q/S262N/V99-Q144del->(GGGGS)n, mature numbering, where n = 1 to 5
  REPEAT (99)...(103): occurring 1, 2, 3, 4 or 5 times

SEQ ID NO: 665 - protein, 444 aa, Artificial Sequence; identical to SEQ ID NO: 637
  human ADA2 R219Q/S262N/C105-T147del->(GGGGS)n, mature numbering, where n = 1 to 5
  REPEAT (105)...(109): occurring 1, 2, 3, 4 or 5 times

SEQ ID NO: 666 - protein, 423 aa, Artificial Sequence
  human ADA2 R219Q/S262N/N98-N156Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 667 - protein, 438 aa, Artificial Sequence
  human ADA2 R219Q/S262N/C105-E148Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 668 - protein, 439 aa, Artificial Sequence
  human ADA2 R219Q/S262N/C105-T147Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 669 - protein, 436 aa, Artificial Sequence
  human ADA2 R219Q/S262N/V99-Q144del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 670 - protein, 440 aa, Artificial Sequence
  human ADA2 R219Q/S262N/K371D/C105-T147del->(Gly)n, mature numbering, where n = 2 to 20
  REPEAT (105)...(105): occurring 2, 3, 4, 5, 6, 7, 8, 9, 10, 11, 12, 13, 14, 15, 16, 17, 18, 19 or 20 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 671 - protein, 448 aa, Artificial Sequence
  human ADA2 R219Q/S262N/K371D/C105-T147del->(Gly)15, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFI

SEQ ID NO: 672 - protein, 449 aa, Artificial Sequence
  human ADA2 R219Q/S262N/K371D/C105-T147del->(Gly)10, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 673 - protein, 446 aa, Artificial Sequence
  human ADA2 R219Q/S262N/K371D/C105-T147del->(Gly)7, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 674 - protein, 444 aa, Artificial Sequence
  human ADA2 R219Q/S262N/K371D/C105-T147del->(Gly)5, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 675 - protein, 442 aa, Artificial Sequence
  human ADA2 R219Q/S262N/K371D/C105-T147del->(Gly)3, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 676 - protein, 441 aa, Artificial Sequence; identical to SEQ ID NO: 640
  human ADA2 R219Q/S262N/K371D/V99-Q144del->(GGGGS)n, mature numbering, where n = 1 to 5
  REPEAT (99)...(103): occurring 1, 2, 3, 4 or 5 times

SEQ ID NO: 677 - protein, 444 aa, Artificial Sequence; identical to SEQ ID NO: 643
  human ADA2 R219Q/S262N/K371D/C105-T147del->(GGGGS)n, mature numbering, where n = 1 to 5
  REPEAT (105)...(109): occurring 1, 2, 3, 4 or 5 times

SEQ ID NO: 678 - protein, 423 aa, Artificial Sequence
  human ADA2 R219Q/S262N/K371D/N98-N156Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 679 - protein, 438 aa, Artificial Sequence
  human ADA2 R219Q/S262N/K371D/C105-E148Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 680 - protein, 439 aa, Artificial Sequence
  human ADA2 R219Q/S262N/K371D/C105-T147Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 681 - protein, 436 aa, Artificial Sequence
  human ADA2 R219Q/S262N/K371D/V99-Q144del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWDKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 682 - protein, 482 aa, Artificial Sequence
  human ADA2 R219Q/S262N/K13E, mature numbering
IDETRAHLLLKEEMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 683 - protein, 482 aa, Artificial Sequence
  human ADA2 R219Q/S262N/K371A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 684 - protein, 482 aa, Artificial Sequence
  human ADA2 R219Q/S262N/K372A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKADIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 685 - protein, 482 aa, Artificial Sequence
  human ADA2 R219Q/S262N/K372D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKDDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 686 - protein, 482 aa, Artificial Sequence
  human ADA2 R219Q/S262N/K372E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKEDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 687 - protein, 482 aa, Artificial Sequence
  human ADA2 R219Q/S262N/K452A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIAYSTLLESEKNTFMEIWKKRWDKFIADVATK

SEQ ID NO: 688 - protein, 482 aa, Artificial Sequence
  human ADA2 R219Q/S262N/K452D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIDYSTLLESEKNTFMEIWKKRWDKFIADVATK

SEQ ID NO: 689 - protein, 482 aa, Artificial Sequence
  human ADA2 R219Q/S262N/K452E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIEYSTLLESEKNTFMEIWKKRWDKFIADVATK

SEQ ID NO: 690 - protein, 482 aa, Artificial Sequence
  human ADA2 R219Q/S262N/R20A, mature numbering
IDETRAHLLLKEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 691 - protein, 482 aa, Artificial Sequence
  human ADA2 R219Q/S262N/R20D, mature numbering
IDETRAHLLLKEKMMRLGGDLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 692 - protein, 482 aa, Artificial Sequence
  human ADA2 R219Q/S262N/R366A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVATYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 693 - protein, 482 aa, Artificial Sequence
  human ADA2 R219Q/S262N/R366D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVDTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 694 - protein, 482 aa, Artificial Sequence
  human ADA2 R219Q/S262N/R366E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVETYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 695 - protein, 482 aa, Artificial Sequence
  human ADA2 R219Q/S262N/H264A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDARSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 696 - protein, 482 aa, Artificial Sequence
  human ADA2 R219Q/S262N/H264Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDQRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 697 - protein, 482 aa, Artificial Sequence
  human ADA2 R219Q/S262N/H264N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDNRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 698 - protein, 482 aa, Artificial Sequence
  human ADA2 R219Q/S262N/H264G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDGRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 699 - protein, 482 aa, Artificial Sequence
  human ADA2 R219K/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAKLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 700 - protein, 482 aa, Artificial Sequence
  human ADA2 R219N/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRANLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 701 - protein, 482 aa, Artificial Sequence
  human ADA2 R219A/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAALLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 702 - protein, 482 aa, Artificial Sequence
  human ADA2 R219Q/S262N/L221A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLAPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 703 - protein, 482 aa, Artificial Sequence
  human ADA2 R219Q/S262N/L221V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLVPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 704 - protein, 482 aa, Artificial Sequence
  human ADA2 R219Q/S262N/L221G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLGPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 705 - protein, 482 aa, Artificial Sequence
  human ADA2 R219Q/S262N/E179D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFDTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 706 - protein, 482 aa, Artificial Sequence
  human ADA2 R219Q/S262N/E179A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFATIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 707 - protein, 482 aa, Artificial Sequence
  human ADA2 R219Q/S262N/E179S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFSTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 708 - protein, 482 aa, Artificial Sequence
  human ADA2 R219Q/S262N/E179T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFTTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 709 - protein, 482 aa, Artificial Sequence
  human ADA2 R219Q/S262N/E179V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFVTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 710 - protein, 482 aa, Artificial Sequence
  human ADA2 R219Q/S262N/E179G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFGTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 711 - protein, 482 aa, Artificial Sequence
  human ADA2 R219Q/S262A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYADHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 712 - protein, 482 aa, Artificial Sequence
  human ADA2 R219Q/S262V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYVDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 713 - protein, 482 aa, Artificial Sequence
  human ADA2 R219Q/S262M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYMDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 714 - protein, 482 aa, Artificial Sequence
  human ADA2 R219Q/S262N/K11A/R20A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 715 - protein, 482 aa, Artificial Sequence
  human ADA2 R219Q/S262N/K11A/R20A/K371A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 716 - protein, 482 aa, Artificial Sequence
  human ADA2 R219Q/S262N/R20A/K371A, mature numbering
IDETRAHLLLKEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 717 - protein, 482 aa, Artificial Sequence
  human ADA2 R219Q/S262N/K11A/K371A, mature numbering
IDETRAHLLLAEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 718 - protein, 482 aa, Artificial Sequence
  human ADA2 R219Q/S262N/K26A, mature numbering
IDETRAHLLLKEKMMRLGGRLVLNTAEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 719 - protein, 482 aa, Artificial Sequence
  human ADA2 R219Q/S262N/K26D, mature numbering
IDETRAHLLLKEKMMRLGGRLVLNTDEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 720 - protein, 482 aa, Artificial Sequence
  human ADA2 R219Q/S262N/K26E, mature numbering
IDETRAHLLLKEKMMRLGGRLVLNTEEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 721 - protein, 482 aa, Artificial Sequence
  human ADA2 R219Q/S262N/R217A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIAAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 722 - protein, 482 aa, Artificial Sequence
  human ADA2 R219Q/S262N/R217D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIDAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 723 - protein, 482 aa, Artificial Sequence
  human ADA2 R219Q/S262N/R217E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIEAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 724 - protein, 482 aa, Artificial Sequence
  human ADA2 R219Q/S262N/K258A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIAIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 725 - protein, 482 aa, Artificial Sequence
  human ADA2 R219Q/S262N/K258D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIDIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 726 - protein, 482 aa, Artificial Sequence
  human ADA2 R219Q/S262N/K258E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIEIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 727 - protein, 482 aa, Artificial Sequence
  human ADA2 R219Q/S262N/R277A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIAMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 728 - protein, 482 aa, Artificial Sequence
  human ADA2 R219Q/S262N/R277D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIDMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 729 - protein, 482 aa, Artificial Sequence
  human ADA2 R219Q/S262N/R277E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIEMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 730 - protein, 482 aa, Artificial Sequence
  human ADA2 R219Q/S262N/R283A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLAIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 731 - protein, 482 aa, Artificial Sequence
  human ADA2 R219Q/S262N/R283D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLDIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 732 - protein, 482 aa, Artificial Sequence
  human ADA2 R219Q/S262N/R283E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLEIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 733 - protein, 482 aa, Artificial Sequence
  human ADA2 R219Q/S262N/K309A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYAEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 734 - protein, 482 aa, Artificial Sequence
  human ADA2 R219Q/S262N/K309D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYDEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 735 - protein, 482 aa, Artificial Sequence
  human ADA2 R219Q/S262N/K309E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYEEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 736 - protein, 482 aa, Artificial Sequence
  human ADA2 R219Q/S262N/K317A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAADGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 737 - protein, 482 aa, Artificial Sequence
  human ADA2 R219Q/S262N/K317D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPADDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 738 - protein, 482 aa, Artificial Sequence
  human ADA2 R219Q/S262N/K317E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAEDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 739 - protein, 482 aa, Artificial Sequence
  human ADA2 R219Q/S262N/K321A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVALPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 740 - protein, 482 aa, Artificial Sequence
  human ADA2 R219Q/S262N/K321D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVDLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 741 - protein, 482 aa, Artificial Sequence
  human ADA2 R219Q/S262N/K321E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVELPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 742 - protein, 482 aa, Artificial Sequence
  human ADA2 R219Q/S262N/R352A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTAIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 743 - protein, 482 aa, Artificial Sequence
  human ADA2 R219Q/S262N/R352D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTDIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 744 - protein, 482 aa, Artificial Sequence
  human ADA2 R219Q/S262N/R352E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTEIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 745 - protein, 482 aa, Artificial Sequence
  human ADA2 R219Q/S262N/R441A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLATLKQLAMNSIKYSTLLESEKNTFMEIWKKRWDKFIADVATK

SEQ ID NO: 746 - protein, 482 aa, Artificial Sequence
  human ADA2 R219Q/S262N/R441D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLDTLKQLAMNSIKYSTLLESEKNTFMEIWKKRWDKFIADVATK

SEQ ID NO: 747 - protein, 482 aa, Artificial Sequence
  human ADA2 R219Q/S262N/R441E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLETLKQLAMNSIKYSTLLESEKNTFMEIWKKRWDKFIADVATK

SEQ ID NO: 748 - protein, 482 aa, Artificial Sequence
  human ADA2 R219Q/S262N/K444A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLAQLAMNSIKYSTLLESEKNTFMEIWKKRWDKFIADVATK

SEQ ID NO: 749 - protein, 482 aa, Artificial Sequence
  human ADA2 R219Q/S262N/K444D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLDQLAMNSIKYSTLLESEKNTFMEIWKKRWDKFIADVATK

SEQ ID NO: 750 - protein, 482 aa, Artificial Sequence
  human ADA2 R219Q/S262N/K444E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLEQLAMNSIKYSTLLESEKNTFMEIWKKRWDKFIADVATK

SEQ ID NO: 751 - protein, 482 aa, Artificial Sequence
  human ADA2 R219Q/S262N/K461A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEANTFMEIWKKRWDKFIADVATK

SEQ ID NO: 752 - protein, 482 aa, Artificial Sequence
  human ADA2 R219Q/S262N/K461D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEDNTFMEIWKKRWDKFIADVATK

SEQ ID NO: 753 - protein, 482 aa, Artificial Sequence
  human ADA2 R219Q/S262N/K461E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEENTFMEIWKKRWDKFIADVATK

SEQ ID NO: 754 - protein, 482 aa, Artificial Sequence
  human ADA2 R219Q/S262N/K469A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWAKRWDKFIADVATK

SEQ ID NO: 755 - protein, 482 aa, Artificial Sequence
  human ADA2 R219Q/S262N/K469D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWDKRWDKFIADVATK

SEQ ID NO: 756 - protein, 482 aa, Artificial Sequence
  human ADA2 R219Q/S262N/K469E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWEKRWDKFIADVATK

SEQ ID NO: 757 - protein, 482 aa, Artificial Sequence
  human ADA2 R219Q/S262N/K470A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKARWDKFIADVATK

SEQ ID NO: 758 - protein, 482 aa, Artificial Sequence
  human ADA2 R219Q/S262N/K470D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKDRWDKFIADVATK

SEQ ID NO: 759 - protein, 482 aa, Artificial Sequence
  human ADA2 R219Q/S262N/K470E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKERWDKFIADVATK

SEQ ID NO: 760 - protein, 482 aa, Artificial Sequence
  human ADA2 R219Q/S262N/D86A, mature numbering
IDETRAHLLLKEKMMRLGGRLVLNTKEELANERLMTLKIAEMKEAMRTLIFPPSMHFFQAKHLIERSQVFNILRMMPKGAALHLHAIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 761 - protein, 482 aa, Artificial Sequence
  human ADA2 R219Q/S262N/D86C, mature numbering
IDETRAHLLLKEKMMRLGGRLVLNTKEELANERLMTLKIAEMKEAMRTLIFPPSMHFFQAKHLIERSQVFNILRMMPKGAALHLHCIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 762 - protein, 482 aa, Artificial Sequence
  human ADA2 R219Q/S262N/D86E, mature numbering
IDETRAHLLLKEKMMRLGGRLVLNTKEELANERLMTLKIAEMKEAMRTLIFPPSMHFFQAKHLIERSQVFNILRMMPKGAALHLHEIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 763 - protein, 482 aa, Artificial Sequence
  human ADA2 R219Q/S262N/D86F, mature numbering
IDETRAHLLLKEKMMRLGGRLVLNTKEELANERLMTLKIAEMKEAMRTLIFPPSMHFFQAKHLIERSQVFNILRMMPKGAALHLHFIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 764 - protein, 482 aa, Artificial Sequence
  human ADA2 R219Q/S262N/D86G, mature numbering
IDETRAHLLLKEKMMRLGGRLVLNTKEELANERLMTLKIAEMKEAMRTLIFPPSMHFFQAKHLIERSQVFNILRMMPKGAALHLHGIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 765 - protein, 482 aa, Artificial Sequence
  human ADA2 R219Q/S262N/D86H, mature numbering
IDETRAHLLLKEKMMRLGGRLVLNTKEELANERLMTLKIAEMKEAMRTLIFPPSMHFFQAKHLIERSQVFNILRMMPKGAALHLHHIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 766 - protein, 482 aa, Artificial Sequence
  human ADA2 R219Q/S262N/D86I, mature numbering
IDETRAHLLLKEKMMRLGGRLVLNTKEELANERLMTLKIAEMKEAMRTLIFPPSMHFFQAKHLIERSQVFNILRMMPKGAALHLHIIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 767 - protein, 482 aa, Artificial Sequence
  human ADA2 R219Q/S262N/D86K, mature numbering
IDETRAHLLLKEKMMRLGGRLVLNTKEELANERLMTLKIAEMKEAMRTLIFPPSMHFFQAKHLIERSQVFNILRMMPKGAALHLHKIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 768 - protein, 482 aa, Artificial Sequence
  human ADA2 R219Q/S262N/D86L, mature numbering
IDETRAHLLLKEKMMRLGGRLVLNTKEELANERLMTLKIAEMKEAMRTLIFPPSMHFFQAKHLIERSQVFNILRMMPKGAALHLHLIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 769 - protein, 482 aa, Artificial Sequence
  human ADA2 R219Q/S262N/D86M, mature numbering
IDETRAHLLLKEKMMRLGGRLVLNTKEELANERLMTLKIAEMKEAMRTLIFPPSMHFFQAKHLIERSQVFNILRMMPKGAALHLHMIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 770 - protein, 482 aa, Artificial Sequence
  human ADA2 R219Q/S262N/D86N, mature numbering
IDETRAHLLLKEKMMRLGGRLVLNTKEELANERLMTLKIAEMKEAMRTLIFPPSMHFFQAKHLIERSQVFNILRMMPKGAALHLHNIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 771 - protein, 482 aa, Artificial Sequence
  human ADA2 R219Q/S262N/D86P, mature numbering
IDETRAHLLLKEKMMRLGGRLVLNTKEELANERLMTLKIAEMKEAMRTLIFPPSMHFFQAKHLIERSQVFNILRMMPKGAALHLHPIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 772 - protein, 482 aa, Artificial Sequence
  human ADA2 R219Q/S262N/D86Q, mature numbering
IDETRAHLLLKEKMMRLGGRLVLNTKEELANERLMTLKIAEMKEAMRTLIFPPSMHFFQAKHLIERSQVFNILRMMPKGAALHLHQIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 773 - protein, 482 aa, Artificial Sequence
  human ADA2 R219Q/S262N/D86R, mature numbering
IDETRAHLLLKEKMMRLGGRLVLNTKEELANERLMTLKIAEMKEAMRTLIFPPSMHFFQAKHLIERSQVFNILRMMPKGAALHLHRIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 774 - protein, 482 aa, Artificial Sequence
  human ADA2 R219Q/S262N/D86S, mature numbering
IDETRAHLLLKEKMMRLGGRLVLNTKEELANERLMTLKIAEMKEAMRTLIFPPSMHFFQAKHLIERSQVFNILRMMPKGAALHLHSIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 775 - protein, 482 aa, Artificial Sequence
  human ADA2 R219Q/S262N/D86T, mature numbering
IDETRAHLLLKEKMMRLGGRLVLNTKEELANERLMTLKIAEMKEAMRTLIFPPSMHFFQAKHLIERSQVFNILRMMPKGAALHLHTIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 776 - protein, 482 aa, Artificial Sequence
  human ADA2 R219Q/S262N/D86V, mature numbering
IDETRAHLLLKEKMMRLGGRLVLNTKEELANERLMTLKIAEMKEAMRTLIFPPSMHFFQAKHLIERSQVFNILRMMPKGAALHLHVIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 777 - protein, 482 aa, Artificial Sequence
  human ADA2 R219Q/S262N/D86W, mature numbering
IDETRAHLLLKEKMMRLGGRLVLNTKEELANERLMTLKIAEMKEAMRTLIFPPSMHFFQAKHLIERSQVFNILRMMPKGAALHLHWIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 778 - protein, 482 aa, Artificial Sequence
  human ADA2 R219Q/S262N/D86Y, mature numbering
IDETRAHLLLKEKMMRLGGRLVLNTKEELANERLMTLKIAEMKEAMRTLIFPPSMHFFQAKHLIERSQVFNILRMMPKGAALHLHYIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 779 - protein, 482 aa, Artificial Sequence
  human ADA2 R219Q/S262N/E179C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFCTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 780 - protein, 482 aa, Artificial Sequence
  human ADA2 R219Q/S262N/E179F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFFTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 781 - protein, 482 aa, Artificial Sequence
  human ADA2 R219Q/S262N/E179H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFHTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 782 - protein, 482 aa, Artificial Sequence
  human ADA2 R219Q/S262N/E179I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFITIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 783 - protein, 482 aa, Artificial Sequence
  human ADA2 R219Q/S262N/E179K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFKTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 784 - protein, 482 aa, Artificial Sequence
  human ADA2 R219Q/S262N/E179L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFLTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 785 - protein, 482 aa, Artificial Sequence
  human ADA2 R219Q/S262N/E179M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFMTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 786 - protein, 482 aa, Artificial Sequence
  human ADA2 R219Q/S262N/E179N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFNTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 787 - protein, 482 aa, Artificial Sequence
  human ADA2 R219Q/S262N/E179P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFPTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 788 - protein, 482 aa, Artificial Sequence
  human ADA2 R219Q/S262N/E179Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFQTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 789 - protein, 482 aa, Artificial Sequence
  human ADA2 R219Q/S262N/E179R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFRTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 790 - protein, 482 aa, Artificial Sequence
  human ADA2 R219Q/S262N/E179W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFWTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 791 - protein, 482 aa, Artificial Sequence
  human ADA2 R219Q/S262N/E179Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFYTIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 792 - protein, 482 aa, Artificial Sequence
  human ADA2 R219C/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRACLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 793 - protein, 482 aa, Artificial Sequence
  human ADA2 R219D/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRADLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 794 - protein, 482 aa, Artificial Sequence
  human ADA2 R219E/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAELLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 795 - protein, 482 aa, Artificial Sequence
  human ADA2 R219F/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAFLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 796 - protein, 482 aa, Artificial Sequence
  human ADA2 R219G/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAGLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 797 - protein, 482 aa, Artificial Sequence
  human ADA2 R219H/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAHLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 798 - protein, 482 aa, Artificial Sequence
  human ADA2 R219I/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAILLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 799 - protein, 482 aa, Artificial Sequence
  human ADA2 R219L/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRALLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 800 - protein, 482 aa, Artificial Sequence
  human ADA2 R219M/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAMLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 801 - protein, 482 aa, Artificial Sequence
  human ADA2 R219P/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAPLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 802 - protein, 482 aa, Artificial Sequence
  human ADA2 R219S/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRASLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 803 - protein, 482 aa, Artificial Sequence
  human ADA2 R219T/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRATLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 804 - protein, 482 aa, Artificial Sequence
  human ADA2 R219V/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAVLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 805 - protein, 482 aa, Artificial Sequence
  human ADA2 R219W/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAWLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 806 - protein, 482 aa, Artificial Sequence
  human ADA2 R219Y/S262N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAYLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 807 - protein, 482 aa, Artificial Sequence
  human ADA2 R219Q/S262N/L221C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLCPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 808 - protein, 482 aa, Artificial Sequence
  human ADA2 R219Q/S262N/L221D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLDPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 809 - protein, 482 aa, Artificial Sequence
  human ADA2 R219Q/S262N/L221E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLEPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 810 - protein, 482 aa, Artificial Sequence
  human ADA2 R219Q/S262N/L221F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLFPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 811 - protein, 482 aa, Artificial Sequence
  human ADA2 R219Q/S262N/L221H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLHPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 812 - protein, 482 aa, Artificial Sequence
  human ADA2 R219Q/S262N/L221I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLIPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 813 - protein, 482 aa, Artificial Sequence
  human ADA2 R219Q/S262N/L221K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLKPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 814 - protein, 482 aa, Artificial Sequence
  human ADA2 R219Q/S262N/L221M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLMPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 815 - protein, 482 aa, Artificial Sequence
  human ADA2 R219Q/S262N/L221N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLNPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 816 - protein, 482 aa, Artificial Sequence
  human ADA2 R219Q/S262N/L221P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLPPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 817 - protein, 482 aa, Artificial Sequence
  human ADA2 R219Q/S262N/L221Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLQPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 818 - protein, 482 aa, Artificial Sequence
  human ADA2 R219Q/S262N/L221R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLRPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 819 - protein, 482 aa, Artificial Sequence
  human ADA2 R219Q/S262N/L221S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLSPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 820 - protein, 482 aa, Artificial Sequence
  human ADA2 R219Q/S262N/L221T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLTPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 821 - protein, 482 aa, Artificial Sequence
  human ADA2 R219Q/S262N/L221W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLWPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 822 - protein, 482 aa, Artificial Sequence
  human ADA2 R219Q/S262N/L221Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLYPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 823 - protein, 482 aa, Artificial Sequence
  human ADA2 R219Q/S262C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYCDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 824 - protein, 482 aa, Artificial Sequence
  human ADA2 R219Q/S262D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYDDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 825 - protein, 482 aa, Artificial Sequence
  human ADA2 R219Q/S262E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYEDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 826 - protein, 482 aa, Artificial Sequence
  human ADA2 R219Q/S262F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYFDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 827 - protein, 482 aa, Artificial Sequence
  human ADA2 R219Q/S262G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYGDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 828 - protein, 482 aa, Artificial Sequence
  human ADA2 R219Q/S262H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYHDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 829 - protein, 482 aa, Artificial Sequence
  human ADA2 R219Q/S262I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYIDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 830 - protein, 482 aa, Artificial Sequence
  human ADA2 R219Q/S262K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYKDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 831 - protein, 482 aa, Artificial Sequence
  human ADA2 R219Q/S262L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYLDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 832 - protein, 482 aa, Artificial Sequence
  human ADA2 R219Q/S262P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYPDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 833 - protein, 482 aa, Artificial Sequence
  human ADA2 R219Q/S262Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYQDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 834 - protein, 482 aa, Artificial Sequence
  human ADA2 R219Q/S262R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYRDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 835 - protein, 482 aa, Artificial Sequence
  human ADA2 R219Q/S262T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYTDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 836 - protein, 482 aa, Artificial Sequence
  human ADA2 R219Q/S262W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYWDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 837 - protein, 482 aa, Artificial Sequence
  human ADA2 R219Q/S262Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYYDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 838 - protein, 482 aa, Artificial Sequence
  human ADA2 R219Q/S262N/H264C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDCRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 839 - protein, 482 aa, Artificial Sequence
  human ADA2 R219Q/S262N/H264D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDDRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 840 - protein, 482 aa, Artificial Sequence
  human ADA2 R219Q/S262N/H264E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDERSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 841 - protein, 482 aa, Artificial Sequence
  human ADA2 R219Q/S262N/H264F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDFRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 842 - protein, 482 aa, Artificial Sequence
  human ADA2 R219Q/S262N/H264I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDIRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 843 - protein, 482 aa, Artificial Sequence
  human ADA2 R219Q/S262N/H264K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDKRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 844 - protein, 482 aa, Artificial Sequence
  human ADA2 R219Q/S262N/H264L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDLRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 845 - protein, 482 aa, Artificial Sequence
  human ADA2 R219Q/S262N/H264M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDMRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 846 - protein, 482 aa, Artificial Sequence
  human ADA2 R219Q/S262N/H264P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDPRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 847 - protein, 482 aa, Artificial Sequence
  human ADA2 R219Q/S262N/H264R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDRRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 848 - protein, 482 aa, Artificial Sequence
  human ADA2 R219Q/S262N/H264S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDSRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 849 - protein, 482 aa, Artificial Sequence
  human ADA2 R219Q/S262N/H264T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDTRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 850 - protein, 482 aa, Artificial Sequence
  human ADA2 R219Q/S262N/H264V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDVRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 851 - protein, 482 aa, Artificial Sequence
  human ADA2 R219Q/S262N/H264W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDWRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 852 - protein, 482 aa, Artificial Sequence
  human ADA2 R219Q/S262N/H264Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDYRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 853 - protein, 482 aa, Artificial Sequence
  human ADA2 R219Q/S262N/S266A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRAKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 854 - protein, 482 aa, Artificial Sequence
  human ADA2 R219Q/S262N/S266C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRCKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 855 - protein, 482 aa, Artificial Sequence
  human ADA2 R219Q/S262N/S266D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRDKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 856 - protein, 482 aa, Artificial Sequence
  human ADA2 R219Q/S262N/S266E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHREKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 857 - protein, 482 aa, Artificial Sequence
  human ADA2 R219Q/S262N/S266F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRFKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 858 - protein, 482 aa, Artificial Sequence
  human ADA2 R219Q/S262N/S266G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRGKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 859 - protein, 482 aa, Artificial Sequence
  human ADA2 R219Q/S262N/S266H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRHKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 860 - protein, 482 aa, Artificial Sequence
  human ADA2 R219Q/S262N/S266I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRIKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 861 - protein, 482 aa, Artificial Sequence
  human ADA2 R219Q/S262N/S266K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRKKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 862 - protein, 482 aa, Artificial Sequence
  human ADA2 R219Q/S262N/S266L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRLKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 863 - protein, 482 aa, Artificial Sequence
  human ADA2 R219Q/S262N/S266M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRMKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 864 - protein, 482 aa, Artificial Sequence
  human ADA2 R219Q/S262N/S266N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRNKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 865 - protein, 482 aa, Artificial Sequence
  human ADA2 R219Q/S262N/S266P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRPKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 866 - protein, 482 aa, Artificial Sequence
  human ADA2 R219Q/S262N/S266Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRQKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 867 - protein, 482 aa, Artificial Sequence
  human ADA2 R219Q/S262N/S266R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRRKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 868 - protein, 482 aa, Artificial Sequence
  human ADA2 R219Q/S262N/S266T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRTKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 869 - protein, 482 aa, Artificial Sequence
  human ADA2 R219Q/S262N/S266V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRVKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 870 - protein, 482 aa, Artificial Sequence
  human ADA2 R219Q/S262N/S266W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRWKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 871 - protein, 482 aa, Artificial Sequence
  human ADA2 R219Q/S262N/S266Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRYKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 872 - protein, 482 aa, Artificial Sequence
  human ADA2 R219Q/S262N/K267A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSADVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 873 - protein, 482 aa, Artificial Sequence
  human ADA2 R219Q/S262N/K267C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSCDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 874 - protein, 482 aa, Artificial Sequence
  human ADA2 R219Q/S262N/K267D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSDDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 875 - protein, 482 aa, Artificial Sequence
  human ADA2 R219Q/S262N/K267E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSEDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 876 - protein, 482 aa, Artificial Sequence
  human ADA2 R219Q/S262N/K267F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSFDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 877 - protein, 482 aa, Artificial Sequence
  human ADA2 R219Q/S262N/K267G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSGDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 878 - protein, 482 aa, Artificial Sequence
  human ADA2 R219Q/S262N/K267H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSHDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 879 - protein, 482 aa, Artificial Sequence
  human ADA2 R219Q/S262N/K267I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSIDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 880 - protein, 482 aa, Artificial Sequence
  human ADA2 R219Q/S262N/K267L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSLDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 881 - protein, 482 aa, Artificial Sequence
  human ADA2 R219Q/S262N/K267M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSMDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 882 - protein, 482 aa, Artificial Sequence
  human ADA2 R219Q/S262N/K267N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSNDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 883 - protein, 482 aa, Artificial Sequence
  human ADA2 R219Q/S262N/K267P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSPDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 884 - protein, 482 aa, Artificial Sequence
  human ADA2 R219Q/S262N/K267Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSQDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 885 - protein, 482 aa, Artificial Sequence
  human ADA2 R219Q/S262N/K267R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSRDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 886 - protein, 482 aa, Artificial Sequence
  human ADA2 R219Q/S262N/K267S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSSDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 887 - protein, 482 aa, Artificial Sequence
  human ADA2 R219Q/S262N/K267T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSTDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 888 - protein, 482 aa, Artificial Sequence
  human ADA2 R219Q/S262N/K267V, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSVDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 889 - protein, 482 aa, Artificial Sequence
  human ADA2 R219Q/S262N/K267W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSWDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 890 - protein, 482 aa, Artificial Sequence
  human ADA2 R219Q/S262N/K267Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSYDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 891 - protein, 482 aa, Artificial Sequence
  human ADA2 R219Q/S262N/V296A, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLAGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 892 - protein, 482 aa, Artificial Sequence
  human ADA2 R219Q/S262N/V296C, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLCGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 893 - protein, 482 aa, Artificial Sequence
  human ADA2 R219Q/S262N/V296D, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLDGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 894 - protein, 482 aa, Artificial Sequence
  human ADA2 R219Q/S262N/V296E, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLEGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 895 - protein, 482 aa, Artificial Sequence
  human ADA2 R219Q/S262N/V296F, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLFGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 896 - protein, 482 aa, Artificial Sequence
  human ADA2 R219Q/S262N/V296G, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLGGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 897 - protein, 482 aa, Artificial Sequence
  human ADA2 R219Q/S262N/V296H, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLHGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 898 - protein, 482 aa, Artificial Sequence
  human ADA2 R219Q/S262N/V296I, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLIGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 899 - protein, 482 aa, Artificial Sequence
  human ADA2 R219Q/S262N/V296K, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLKGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 900 - protein, 482 aa, Artificial Sequence
  human ADA2 R219Q/S262N/V296L, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLLGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 901 - protein, 482 aa, Artificial Sequence
  human ADA2 R219Q/S262N/V296M, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLMGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 902 - protein, 482 aa, Artificial Sequence
  human ADA2 R219Q/S262N/V296N, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLNGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 903 - protein, 482 aa, Artificial Sequence
  human ADA2 R219Q/S262N/V296P, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLPGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 904 - protein, 482 aa, Artificial Sequence
  human ADA2 R219Q/S262N/V296Q, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLQGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 905 - protein, 482 aa, Artificial Sequence
  human ADA2 R219Q/S262N/V296R, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLRGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 906 - protein, 482 aa, Artificial Sequence
  human ADA2 R219Q/S262N/V296S, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLSGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 907 - protein, 482 aa, Artificial Sequence
  human ADA2 R219Q/S262N/V296T, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLTGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 908 - protein, 482 aa, Artificial Sequence
  human ADA2 R219Q/S262N/V296W, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLWGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 909 - protein, 482 aa, Artificial Sequence
  human ADA2 R219Q/S262N/V296Y, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYNDHRSKDVAVIAESIRMAMGLRIKFPTVVAGFDLYGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 910 - protein, 482 aa, Artificial Sequence
  human ADA2 R219Q/K11A/R20A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 911 - protein, 482 aa, Artificial Sequence
  human ADA2 R219Q/K11A/R20A/K371A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 912 - protein, 482 aa, Artificial Sequence
  human ADA2 R219Q/R20A/K371A, mature numbering
IDETRAHLLLKEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 913 - protein, 482 aa, Artificial Sequence
  human ADA2 R219Q/K11A/K371A, mature numbering
IDETRAHLLLAEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 914 - protein, 482 aa, Artificial Sequence
  human ADA2 S262N/K11A/R20A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 915 - protein, 482 aa, Artificial Sequence
  human ADA2 S262N/K11A/R20A/K371A, mature numbering
IDETRAHLLLAEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 916 - protein, 482 aa, Artificial Sequence
  human ADA2 S262N/R20A/K371A, mature numbering
IDETRAHLLLKEKMMRLGGALVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 917 - protein, 482 aa, Artificial Sequence
  human ADA2 S262N/K11A/K371A, mature numbering
IDETRAHLLLAEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWAKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 918 - protein, 440 aa, Artificial Sequence
  human ADA2 R219Q/C105-T147del->(Gly)n, mature numbering, where n = 2 to 20
  REPEAT (105)...(105): occurring 2, 3, 4, 5, 6, 7, 8, 9, 10, 11, 12, 13, 14, 15, 16, 17, 18, 19 or 20 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 919 - protein, 441 aa, Artificial Sequence
  human ADA2 R219Q/V99-Q144del->(GGGGS)n, mature numbering, where n = 1 to 5
  REPEAT (99)...(103): occurring 1, 2, 3, 4 or 5 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 920 - protein, 444 aa, Artificial Sequence
  human ADA2 R219Q/C105-T147del->(GGGGS)n, mature numbering, where n = 1 to 5
  REPEAT (105)...(109): occurring 1, 2, 3, 4 or 5 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 921 - protein, 423 aa, Artificial Sequence
  human ADA2 R219Q/N98-N156Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 922 - protein, 438 aa, Artificial Sequence
  human ADA2 R219Q/C105-E148Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 923 - protein, 439 aa, Artificial Sequence
  human ADA2 R219Q/C105-T147Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 924 - protein, 436 aa, Artificial Sequence
  human ADA2 R219Q/V99-Q144del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNNVTEFDDSLLRNFTLVTQHPEVIYTNQNVVWSKFETIFFTISGLIHYAPVFRDYVFRSMQEFYEDNVLYMEIRAQLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 925 - protein, 440 aa, Artificial Sequence
  human ADA2 S262N/C105-T147del->(Gly)n, mature numbering, where n = 2 to 20
  REPEAT (105)...(105): occurring 2, 3, 4, 5, 6, 7, 8, 9, 10, 11, 12, 13, 14, 15, 16, 17, 18, 19 or 20 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 926 - protein, 441 aa, Artificial Sequence
  human ADA2 S262N/V99-Q144del->(GGGGS)n, mature numbering, where n = 1 to 5
  REPEAT (99)...(103): occurring 1, 2, 3, 4 or 5 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNGGGGSNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 927 - protein, 444 aa, Artificial Sequence
  human ADA2 S262N/C105-T147del->(GGGGS)n, mature numbering, where n = 1 to 5
  REPEAT (105)...(109): occurring 1, 2, 3, 4 or 5 times
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHGGGGSEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 928 - protein, 423 aa, Artificial Sequence
  human ADA2 S262N/N98-N156Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 929 - protein, 438 aa, Artificial Sequence
  human ADA2 S262N/C105-E148Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 930 - protein, 439 aa, Artificial Sequence
  human ADA2 S262N/C105-T147Del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 931 - protein, 436 aa, Artificial Sequence
  human ADA2 S262N/V99-Q144del, mature numbering
IDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYNDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

The invention claimed is:
1. A variant Adenosine Deaminase 2 (ADA2) protein or a catalytically active portion thereof, comprising a modification(s) in the sequence of amino acids of an unmodified ADA2 polypeptide or a catalytically active portion thereof, wherein:
the unmodified ADA2 protein comprises the sequence of amino acids set forth in SEQ ID NO:5, or a sequence of amino acids that exhibits at least 95% sequence identity to the sequence of amino acids set forth in SEQ ID NO:5, or is a catalytically active portion thereof;
the amino acid modification(s) are selected from among amino acid replacement(s), deletion(s) and insertion(s);
the variant ADA2 protein comprises an amino acid replacement at one or both of positions corresponding to amino acid residue 219 and 262 with reference to amino acid positions set forth in SEQ ID NO:5;
the variant ADA2 protein, when in dimer form, exhibits increased adenosine deaminase activity or increased adenosine deaminase activity and reduced heparin binding compared to the dimer form of the unmodified ADA2 protein of SEQ ID NO:5 or dimer form of the catalytically active portion thereof; and
the variant ADA2 protein, when in dimer form, exhibits adenosine deaminase activity to convert adenosine to inosine.

2. The variant ADA2 protein or catalytically active portion thereof of claim 1, wherein the unmodified ADA2 protein is a homodimer, and the monomer form comprises the sequence of amino acid residues set forth in SEQ ID NO:5.

3. A catalytically active portion of the variant ADA2 protein of claim 1, wherein the unmodified ADA2 protein is a homodimer of corresponding catalytically active portions of the polypeptide whose sequence is set forth in SEQ ID NO:5, wherein corresponding portions are determined by alignment.

4. The variant ADA2 protein of claim 1, wherein the unmodified ADA2 protein comprises the sequence of amino acids set forth in any of SEQ ID NOS: 5, 326-334, 340, 375 and 380-383 or is a catalytically active portion thereof.

5. The variant ADA2 protein of claim 1, wherein the unmodified ADA2 protein consists of the sequence of amino acids set forth in any of SEQ ID NOS: 5, 326-334, 340, 375 and 380-383 or is a catalytically active portion thereof.

6. The variant ADA2 protein of claim 1, wherein the unmodified ADA2 protein comprises the sequence of amino acids set forth in SEQ ID NO: 5 or a catalytically active portion thereof.

7. The variant ADA2 protein or catalytically active portion thereof of claim 1, wherein the variant ADA2 protein comprises one or more amino acid replacement(s) selected from among replacements corresponding to R219K; R219Q; R219N; R219A; S262A; S262V; S262M; S262N; S262C; S262D; S262E; S262F; S262G; S262H; S262I; S262K; S262L; S262P; S262Q; S262R; S262T; S262W and S262Y.

8. The variant ADA2 protein or catalytically active portion thereof of claim 1, comprising the replacement corresponding to S262N or S262Q.

9. The variant ADA2 protein or catalytically active portion thereof of claim 1, comprising the replacement corresponding to R219K, R219Q, R219N or R219A.

10. The variant ADA2 protein or catalytically active portion thereof of claim 1, comprising the replacement corresponding to R219Q/S262N.

11. The variant ADA2 protein or catalytically active portion thereof of claim 10, selected from among any of R219Q/S262N/R20N/V22S, R219Q/S262N/K371N/D373S, R219Q/S262N/K372N/I374S, R219Q/S262N/T403N/H405S, R219Q/S262N/G404N/P406S, R219Q/S262N/C105-T147del→(Gly)$_7$, R219Q/S262N/C105-T147del→(Gly)$_{10}$, R219Q/S262N/C105-T147del→(Gly)$_7$, R219Q/S262N/C105-T147del→(Gly)5, R219Q/S262N/C105-T147del→(Gly)$_3$, R219Q/S262N/R125N/P126A, R219Q/S262N/S127N/K129S, R219Q/S262N/P126N/E128T, R219Q/S262N/R112N/I114T, R219Q/S262N/I134N/L135C/L136T, R219Q/S262N/I134N/L135S/L136T, R219Q/S262N/R142N/Q144S, R219Q/S262N/E137N/Y139T, R219Q/S262N/P111N/G113S, R219Q/S262N/F119S, R219Q/S262N/F119K, R219Q/S262N/Y224R, R219Q/S262N/Y224N, R219Q/S262N/Y191S, R219Q/S262N/Y191D, R219Q/S262N/F183K, R219Q/S262N/Y191D/Y224R, R219Q/S262N/F109S, R219Q/S262N/F109A, R219Q/S262N/R118D, R219Q/S262N/R118A, R219Q/S262N/Y139T, R219Q/S262N/Y139A, R219Q/S262N/W133S, R219Q/S262N/W133T, R219Q/S262N/P124A, R219Q/S262N/P124S, R219Q/S262N/V99-Q144del→(GGGGS)$_1$, R219Q/S262N/V99-Q144del→(GGGGS)$_2$, R219Q/S262N/V99-Q144del→(GGGGS)$_3$, R219Q/S262N/C105-T147del→(GGGGS)$_1$, R219Q/S262N/C105-T147del→(GGGGS)$_2$, R219Q/S262N/C105-T147del→(GGGGS)$_3$, R219Q/S262N/K371D/V99-Q144del→(GGGGS)$_1$, R219Q/S262N/K371D/V99-Q144del→(GGGGS)$_2$, R219Q/S262N/K371D/V99-Q144del→(GGGGS)$_3$, R219Q/S262N/K371D/C105-T147del→(GGGGS)$_1$, R219Q/S262N/K371D/C105-T147del→(GGGGS)$_2$, R219Q/S262N/K371D/C105-T147del→(GGGGS)$_3$, R219Q/S262N/C105-T147del→(Gly), R219Q/S262N/K11A, R219Q/S262N/K11D, R219Q/S262N/K11E, R219Q/S262N/K13A, R219Q/S262N/K13D, R219Q/S262N/V99-Q144del→(GGGGS),R219Q/S262N/C105-T147del→(GGGGS)$_n$, R219Q/S262N/N98-N156del, R219Q/S262N/C105-E148del, R219Q/S262N/C105-T147del, R219Q/S262N/V99-Q144del, R219Q/S262N/K371D/C105-T147del→(Gly)$_n$, R219Q/S262N/K371D/C105-T147del→(Gly)$_{15}$, R219Q/S262N/K371D/C105-T147del→(Gly)$_{10}$, R219Q/S262N/K371D/C105-T147del→(Gly)$_7$, R219Q/S262N/K371D/C105-T147del→(Gly)$_5$, R219Q/S262N/K371D/C105-T147del→(Gly)$_3$, R219Q/S262N/K371D/V99-Q144del→(GGGGS)$_n$, R219Q/S262N/K371D/C105-T147del→(GGGGS)$_n$, R219Q/S262N/K371D/N98-N156del, R219Q/S262N/K371D/C105-E148del, R219Q/S262N/K371D/C105-T147del, R219Q/S262N/K371D/V99-Q144del, R219Q/S262N/K13E, R219Q/S262N/K371A, R219Q/S262N/K372A, R219Q/S262N/K372D, R219Q/S262N/K372E, R219Q/S262N/K452A, R219Q/S262N/K452D, R219Q/S262N/K452E, R219Q/S262N/R20A, R219Q/S262N/R20D, R219Q/S262N/R366A, R219Q/S262N/R366D, R219Q/S262N/R366E, R219Q/S262N/H264A, R219Q/S262N/H264Q, R219Q/S262N/H264N, R219Q/S262N/H264G, R219K/S262N, R219N/S262N, R219A/S262N, R219Q/S262N/L221A, R219Q/S262N/L221V, R219Q/S262N/L221G, R219Q/S262N/E179D, R219Q/S262N/E179A, R219Q/S262N/E179S, R219Q/S262N/E179T, R219Q/S262N/E179V, R219Q/S262N/E179G, R219Q/S262A, R219Q/S262V, R219Q/S262M, R219Q/S262N/K11A/R20A, R219Q/S262N/K11A/R20A/K371A, R219Q/S262N/R20A/K371A, R219Q/S262N/K11A/K371A, R219Q/S262N/K26A, R219Q/S262N/K26D, R219Q/S262N/K26E, R219Q/S262N/R217A, R219Q/S262N/R217D, R219Q/S262N/R217E, R219Q/S262N/K258A, R219Q/S262N/K258D, R219Q/S262N/K258E, R219Q/S262N/R277A, R219Q/S262N/R277D, R219Q/S262N/R277E, R219Q/

S262N/R283A, R219Q/S262N/R283D, R219Q/S262N/R283E, R219Q/S262N/K309A, R219Q/S262N/K309D, R219Q/S262N/K309E, R219Q/S262N/K317A, R219Q/S262N/K317D, R219Q/S262N/K317E, R219Q/S262N/K321A, R219Q/S262N/K321D, R219Q/S262N/K321E, R219Q/S262N/R352A, R219Q/S262N/R352D, R219Q/S262N/R352E, R219Q/S262N/R441A, R219Q/S262N/R441D, R219Q/S262N/R441E, R219Q/S262N/K444A, R219Q/S262N/K444D, R219Q/S262N/K444E, R219Q/S262N/K461A, R219Q/S262N/K461D, R219Q/S262N/K461E, R219Q/S262N/K469A, R219Q/S262N/K469D, R219Q/S262N/K469E, R219Q/S262N/K470A, R219Q/S262N/K470D, R219Q/S262N/K470E, R219Q/S262N/D86A, R219Q/S262N/D86C, R219Q/S262N/D86E, R219Q/S262N/D86F, R219Q/S262N/D86G, R219Q/S262N/D86H, R219Q/S262N/D86I, R219Q/S262N/D86K, R219Q/S262N/D86L, R219Q/S262N/D86M, R219Q/S262N/D86N, R219Q/S262N/D86P, R219Q/S262N/D86Q, R219Q/S262N/D86R, R219Q/S262N/D86S, R219Q/S262N/D86T, R219Q/S262N/D86V, R219Q/S262N/D86W, R219Q/S262N/D86Y, R219Q/S262N/E179C, R219Q/S262N/E179F, R219Q/S262N/E179H, R219Q/S262N/E179I, R219Q/S262N/E179K, R219Q/S262N/E179L, R219Q/S262N/E179M, R219Q/S262N/E179N, R219Q/S262N/E179P, R219Q/S262N/E179Q, R219Q/S262N/E179R, R219Q/S262N/E179W, R219Q/S262N/E179Y, R219C/S262N, R219D/S262N, R219E/S262N, R219F/S262N, R219G/S262N, R219H/S262N, R219I/S262N, R219L/S262N, R219M/S262N, R219P/S262N, R219S/S262N, R219T/S262N, R219V/S262N, R219W/S262N, R219Y/S262N, R219Q/S262N/L221C, R219Q/S262N/L221D, R219Q/S262N/L221E, R219Q/S262N/L221F, R219Q/S262N/L221H, R219Q/S262N/L221I, R219Q/S262N/L221K, R219Q/S262N/L221M, R219Q/S262N/L221N, R219Q/S262N/L221P, R219Q/S262N/L221Q, R219Q/S262N/L221R, R219Q/S262N/L221S, R219Q/S262N/L221T, R219Q/S262N/L221W, R219Q/S262N/L221Y, R219Q/S262C, R219Q/S262D, R219Q/S262E, R219Q/S262F, R219Q/S262G, R219Q/S262H, R219Q/S262I, R219Q/S262K, R219Q/S262L, R219Q/S262P, R219Q/S262Q, R219Q/S262R, R219Q/S262T, R219Q/S262W, R219Q/S262Y, R219Q/S262N/H264C, R219Q/S262N/H264D, R219Q/S262N/H264E, R219Q/S262N/H264F, R219Q/S262N/H264I, R219Q/S262N/H264K, R219Q/S262N/H264L, R219Q/S262N/H264M, R219Q/S262N/H264P, R219Q/S262N/H264R, R219Q/S262N/H264S, R219Q/S262N/H264T, R219Q/S262N/H264V, R219Q/S262N/H264W, R219Q/S262N/H264Y, R219Q/S262N/S266A, R219Q/S262N/S266C, R219Q/S262N/S266D, R219Q/S262N/S266E, R219Q/S262N/S266F, R219Q/S262N/S266G, R219Q/S262N/S266H, R219Q/S262N/S266I, R219Q/S262N/S266K, R219Q/S262N/S266L, R219Q/S262N/S266M, R219Q/S262N/S266N, R219Q/S262N/S266P, R219Q/S262N/S266Q, R219Q/S262N/S266R, R219Q/S262N/S266T, R219Q/S262N/S266V, R219Q/S262N/S266W, R219Q/S262N/S266Y, R219Q/S262N/K267A, R219Q/S262N/K267C, R219Q/S262N/K267D, R219Q/S262N/K267E, R219Q/S262N/K267F, R219Q/S262N/K267G, R219Q/S262N/K267H, R219Q/S262N/K267I, R219Q/S262N/K267L, R219Q/S262N/K267M, R219Q/S262N/K267N, R219Q/S262N/K267P, R219Q/S262N/K267Q, R219Q/S262N/K267R, R219Q/S262N/K267S, R219Q/S262N/K267T, R219Q/S262N/K267V, R219Q/S262N/K267W, R219Q/S262N/K267Y, R219Q/S262N/V296A, R219Q/S262N/V296C, R219Q/S262N/V296D, R219Q/S262N/V296E, R219Q/S262N/V296F, R219Q/S262N/V296G, R219Q/S262N/V296H, R219Q/S262N/V296I, R219Q/S262N/V296K, R219Q/S262N/V296L, R219Q/S262N/V296M, R219Q/S262N/V296N, R219Q/S262N/V296P, R219Q/S262N/V296Q, R219Q/S262N/V296R, R219Q/S262N/V296S, R219Q/S262N/V296T, R219Q/S262N/V296W and R219Q/S262N/V296Y.

12. The variant ADA2 protein of claim 1, wherein the variant ADA2 protein comprises amino acid replacements selected from among R219Q/S262N/K371E, R219Q/S262N/K371D, R219Q/S262N/R20E and R219Q/S262N/K371D/R20E.

13. The variant ADA2 protein or catalytically active portion thereof of claim 1 that comprises the modifications corresponding to R219Q/S262N/--→N1/--→A2/--→S3; R219Q/S262N/R20N/V22S; R219Q/S262N/K371N/D373S; R219Q/S262N/K372N/I374S; R219Q/S262N/T403N/H405S; or R219Q/S262N/G404N/P406S.

14. The variant ADA2 protein or catalytically active portion thereof of claim 1 that comprises amino acid replacements corresponding to R219Q/S262N/R125N/P126A; R219Q/S262N/S127N/K129S; R219Q/S262N/P126N/E128T; R219Q/S262N/R112N/I114T; R219Q/S262N/I134N/L135C/L136T; R219Q/S262N/I134N/L135S/L136T; R219Q/S262N/R142N/Q144S; R219Q/S262N/E137N/Y139T; or R219Q/S262N/P111N/G113S.

15. The variant ADA2 protein or catalytically active portion thereof of claim 1, further comprising a modification in the putative receptor binding (PRB) domain corresponding to one or more of the modifications selected from among: R125N/P126A; S127N/K129S; P126N/E128T; R112N/I114T; I134N/L135C/L136T; I134N/L135S/L136T; R142N/Q144S; E137N/Y139T; and P111N/G113S.

16. The variant ADA2 protein or catalytically active portion thereof of claim 1, comprising amino acid replacements selected from among replacements corresponding to R219Q/S262N/F119S; R219Q/S262N/F119K; R219Q/S262N/Y224R; R219Q/S262N/Y224N; R219Q/S262N/Y191S; R219Q/S262N/Y191D; R219Q/S262N/F183K; R219Q/S262N/Y191D/Y224R; R219Q/S262N/F109S; R219Q/S262N/F109A; R219Q/S262N/R118D; R219Q/S262N/R118A; R219Q/S262N/Y139T; R219Q/S262N/Y139A; R219Q/S262N/W133S; R219Q/S262N/W133T; R219Q/S262N/P124A; and R219Q/S262N/P124S.

17. The variant ADA2 protein or catalytically active portion thereof of claim 1 that comprises amino acid replacements selected from among replacements corresponding to R219Q/S262N/C105-T147del→$(Gly)_{15}$; R219Q/S262N/C105-T147del→$(Gly)_{10}$; R219Q/S262N/C105-T147del→$(Gly)_{7}$; R219Q/S262N/C105-T147del→$(Gly)_{5}$; R219Q/S262N/C105-T147del→$(Gly)_{3}$; R219Q/S262N/V99-Q144del→$(GGGGS)_{1}$; R219Q/S262N/V99-Q144del→$(GGGGS)_{2}$; R219Q/S262N/V99-Q144del→$(GGGGS)_{3}$; R219Q/S262N/C105-T147del→$(GGGGS)_{1}$; R219Q/S262N/C105-T147del→$(GGGGS)_{2}$; R219Q/S262N/C105-T147del→$(GGGGS)_{3}$; R219Q/S262N/K371D/V99-Q144del→$(GGGGS)_{1}$; R219Q/S262N/K371D/V99-Q144del→$(GGGGS)_{2}$; R219Q/S262N/K371D/V99-Q144del→$(GGGGS)_{3}$; R219Q/S262N/K371D/C105-T147del→$(GGGGS)_{1}$; R219Q/S262N/K371D/C105-T147del→$(GGGGS)_{2}$; R219Q/S262N/K371D/C105-T147del→$(GGGGS)_{3}$; R219Q/S262N/C105-T147del→$(Gly)_{n}$, where n=2 to 20; R219Q/S262N/V99-Q144del→$(GGGGS)_{n}$, where n=1 to 5; R219Q/S262N/C105-T147del→$(GGGGS)_{n}$, where n=1 to 5; R219Q/S262N/N98-N156del; R219Q/S262N/C105-E148del; R219Q/S262N/C105-T147del; R219Q/S262N/V99-Q144del; R219Q/S262N/K371D/C105-T147del→$(Gly)_{n}$, where n=2 to 20; R219Q/S262N/K371D/C105-T147del→(Gly)$_{15}$; R219Q/S262N/K371D/C105-T147del→(Gly)$_{10}$; R219Q/S262N/K371D/C105-T147del→(Gly)$_{7}$; R219Q/S262N/K371D/C105-T147del→(Gly)$_{5}$; R219Q/S262N/K371D/C105-T147del→(Gly)$_{3}$; R219Q/S262N/K371D/V99-Q144del→(GGGGS)$_{n}$, where n=1 to 5; R219Q/S262N/K371D/C105-T147del→(GGGGS)$_{n}$, where n=1 to 5; R219Q/S262N/K371D/N98-N156del; R219Q/S262N/K371D/C105-E148del; R219Q/S262N/K371D/C105-T147del; and R219Q/S262N/K371D/V99-Q144del, with reference to amino acid positions set forth in SEQ ID NO:5.

18. The variant ADA2 protein or catalytically active portion thereof of claim 1, wherein the variant ADA2 protein comprises the sequence of amino acids set forth in any of SEQ ID NOS:38-41, 51-54, 59-63, 145-159, 176-190 and 263-273 or a catalytically active portion thereof.

19. The variant ADA2 protein or catalytically active portion thereof of claim 1, wherein the variant ADA2 protein comprises the sequence of amino acids set forth in any of SEQ ID NOS: 596-645 and 658-931 or a catalytically active portion thereof.

20. The variant ADA2 protein or catalytically active portion thereof of claim 1, comprising amino acid replacements selected from among replacements corresponding to R219Q/S262N/K371D; R219Q/S262N/R20E; R219Q/S262N/K371E/R20E; R219Q/S262N/K371D/R20E; R219Q/S262N; R219Q/S262N/K11A; R219Q/S262N/K11D; R219Q/S262N/K11E; R219Q/S262N/K13A; R219Q/S262N/K13D; R219Q/S262N/K13E; R219Q/S262N/K371A; R219Q/S262N/K372A; R219Q/S262N/K372D; R219Q/S262N/K372E; R219Q/S262N/K452A; R219Q/S262N/K452D; R219Q/S262N/K452E; R219Q/S262N/R20A; R219Q/S262N/R20D; R219Q/S262N/R366A; R219Q/S262N/R366D; R219Q/S262N/R366E; R219Q/S262N/H264A; R219Q/S262N/H264Q; R219Q/S262N/H264N; R219Q/S262N/H264G; R219K/S262N; R219N/S262N; R219A/S262N; R219Q/S262N/L221A; R219Q/S262N/L221V; R219Q/S262N/L221G; R219Q/S262N/E179D; R219Q/S262N/E179A; R219Q/S262N/E179S; R219Q/S262N/E179T; R219Q/S262N/E179V; R219Q/S262N/E179G; R219Q/S262A; R219Q/S262V; R219Q/S262M; R219Q/S262N/K11A/R20A; R219Q/S262N/K11A/R20A/K371A; R219Q/S262N/R20A/K371A; R219Q/S262N/K11A/K371A; R219Q/S262N/K26A; R219Q/S262N/K26D; R219Q/S262N/K26E; R219Q/S262N/R217A; R219Q/S262N/R217D; R219Q/S262N/R217E; R219Q/S262N/K258A; R219Q/S262N/K258D; R219Q/S262N/K258E; R219Q/S262N/R277A; R219Q/S262N/R277D; R219Q/S262N/R277E; R219Q/S262N/R283A; R219Q/S262N/R283D; R219Q/S262N/R283E; R219Q/S262N/K309A; R219Q/S262N/K309D; R219Q/S262N/K309E; R219Q/S262N/K317A; R219Q/S262N/K317D; R219Q/S262N/K317E; R219Q/S262N/K321A; R219Q/S262N/K321D; R219Q/S262N/K321E; R219Q/S262N/R352A; R219Q/S262N/R352D; R219Q/S262N/R352E; R219Q/S262N/R441A; R219Q/S262N/R441D; R219Q/S262N/R441E; R219Q/S262N/K444A; R219Q/S262N/K444D; R219Q/S262N/K444E; R219Q/S262N/K461A; R219Q/S262N/K461D; R219Q/S262N/K461E; R219Q/S262N/K469A; R219Q/S262N/K469D; R219Q/S262N/K469E; R219Q/S262N/K470A; R219Q/S262N/K470D; R219Q/S262N/K470E; R219Q/S262N/D86A; R219Q/S262N/D86C; R219Q/S262N/D86E; R219Q/S262N/D86F; R219Q/S262N/D86G; R219Q/S262N/D86H; R219Q/S262N/D86I; R219Q/S262N/D86K; R219Q/S262N/D86L; R219Q/S262N/D86M; R219Q/S262N/D86N; R219Q/S262N/D86P; R219Q/S262N/D86Q; R219Q/S262N/D86R; R219Q/S262N/D86S; R219Q/S262N/D86T; R219Q/S262N/D86V; R219Q/S262N/D86W; R219Q/S262N/D86Y; R219Q/S262N/E179C; R219Q/S262N/E179F; R219Q/S262N/E179H; R219Q/S262N/E179I; R219Q/S262N/E179K; R219Q/S262N/E179L; R219Q/S262N/E179M; R219Q/S262N/E179N; R219Q/S262N/E179P; R219Q/S262N/E179Q; R219Q/S262N/E179R; R219Q/S262N/E179W; R219Q/S262N/E179Y; R219C/S262N; R219D/S262N; R219E/S262N; R219F/S262N; R219G/S262N; R219H/S262N; R219I/S262N; R219L/S262N; R219M/S262N; R219P/S262N; R219S/S262N; R219T/S262N; R219V/S262N; R219W/S262N; R219Y/S262N; R219Q/S262N/L221C; R219Q/S262N/L221D; R219Q/S262N/L221E; R219Q/S262N/L221F; R219Q/S262N/L221H; R219Q/S262N/L221I; R219Q/S262N/L221K; R219Q/S262N/L221M; R219Q/S262N/L221N; R219Q/S262N/L221P; R219Q/S262N/L221Q; R219Q/S262N/L221R; R219Q/S262N/L221S; R219Q/S262N/L221T; R219Q/S262N/L221W; R219Q/S262N/L221Y; R219Q/S262C; R219Q/S262D; R219Q/S262E; R219Q/S262F; R219Q/S262G; R219Q/S262H; R219Q/S262I; R219Q/S262K; R219Q/S262L; R219Q/S262P; R219Q/S262Q; R219Q/S262R; R219Q/S262T; R219Q/S262W; R219Q/S262Y; R219Q/S262N/H264C; R219Q/S262N/H264D; R219Q/S262N/H264E; R219Q/S262N/H264F; R219Q/S262N/H264I; R219Q/S262N/H264K; R219Q/S262N/H264L; R219Q/S262N/H264M; R219Q/S262N/H264P; R219Q/S262N/H264R; R219Q/S262N/H264S; R219Q/S262N/H264T; R219Q/S262N/H264V; R219Q/S262N/H264W; R219Q/S262N/H264Y; R219Q/S262N/S266A; R219Q/S262N/S266C; R219Q/S262N/S266D; R219Q/S262N/S266E; R219Q/S262N/S266F; R219Q/S262N/S266G; R219Q/S262N/S266H; R219Q/S262N/S266I; R219Q/S262N/S266K; R219Q/S262N/S266L; R219Q/S262N/S266M; R219Q/S262N/S266N; R219Q/S262N/S266P; R219Q/S262N/S266Q; R219Q/S262N/S266R; R219Q/S262N/S266T; R219Q/S262N/S266V; R219Q/S262N/S266W; R219Q/S262N/S266Y; R219Q/S262N/K267A; R219Q/S262N/K267C; R219Q/S262N/K267D; R219Q/S262N/K267E; R219Q/S262N/K267F; R219Q/S262N/K267G; R219Q/S262N/K267H; R219Q/S262N/K267I; R219Q/S262N/K267L; R219Q/S262N/K267M; R219Q/S262N/K267N; R219Q/S262N/K267P; R219Q/S262N/K267Q; R219Q/S262N/K267R; R219Q/S262N/K267S; R219Q/S262N/K267T; R219Q/S262N/K267V; R219Q/S262N/K267W; R219Q/S262N/K267Y; R219Q/S262N/V296A; R219Q/S262N/V296C; R219Q/S262N/V296D; R219Q/S262N/V296E; R219Q/S262N/V296F; R219Q/S262N/V296G; R219Q/S262N/V296H; R219Q/S262N/V296I; R219Q/S262N/V296K; R219Q/S262N/V296L; R219Q/S262N/V296M; R219Q/S262N/V296N; R219Q/S262N/V296P; R219Q/S262N/V296Q; R219Q/S262N/V296R; R219Q/S262N/V296S; R219Q/S262N/V296T; R219Q/S262N/V296W; R219Q/S262N/V296Y; R219Q/K11A/R20A; R219Q/K11A/R20A/K371A; R219Q/R20A/K371A; R219Q/K11A/K371A; S262N/K11A/R20A; S262N/K11A/R20A/K371A; S262N/R20A/K371A; and S262N/K11A/K371A, with reference to SEQ ID NO:5.

21. The variant ADA2 protein or catalytically active portion thereof of claim 10, wherein the sequence of the ADA2 portion is set forth in SEQ ID NO:273.

22. The variant ADA2 protein or catalytically active portion thereof of claim 21, wherein the ADA2 protein is PEGylated.

23. A catalytically active portion of the variant ADA2 protein or catalytically active portion thereof of claim 1, wherein the catalytically active portion comprises the ADA domain.

24. A variant ADA2 multimer, comprising a plurality of variant ADA2 proteins or catalytically active portions thereof of claim 1, wherein the variant ADA2 protein or catalytically active portion thereof are the same or different.

25. A variant ADA2 dimer, comprising a variant ADA2 protein or catalytically active portion thereof of claim 1.

26. A variant ADA2 dimer, comprising a variant ADA2 protein or catalytically active portion thereof of claim 10.

27. The variant ADA2 dimer or catalytically active portion thereof of claim 25 that is a homodimer comprising two variant ADA2 proteins or catalytically active portions thereof that are the same.

28. The variant ADA2 dimer or catalytically active portion thereof of claim 25 that is a heterodimer comprising two variant ADA2 proteins or catalytically active portions thereof that are different from each other.

29. A conjugate, comprising an ADA2 protein or catalytically active portion thereof a claim 1, linked by chemical or physical interaction directly or indirectly via a linker to a heterologous moiety, wherein the heterologous moiety is a half-life extending moiety.

30. The conjugate of claim 29, wherein the a half-life extending moiety is a PEG and the ADA2 protein or catalytically active portion thereof is PEGylated.

31. A nucleic acid encoding a variant ADA2 protein or catalytically active portion thereof of claim 1.

32. A vector, comprising the nucleic acid molecule of claim 31.

33. An isolated cell or a cell culture, comprising the vector of claim 32.

34. The cell or cell culture of claim 33, wherein the cell is a selected from a tumor-infiltrating lymphocyte (TIL), a cytotoxic T lymphocyte (CTL), a natural killer (NK) cell or a lymphokine-activated killer (LAK) cell.

35. The cell or cell culture of claim 34, wherein the cell is a T cell that encodes and expresses chimeric antigen receptor (CAR) and the variant ADA2 protein or dimer, wherein the CAR is specific for a tumor cell antigen.

36. A method of producing an ADA2 variant or catalytically active portion thereof, comprising culturing a cell of claim 33, under conditions whereby the ADA2 variant is expressed.

37. The method of claim 36, wherein the resulting ADA2 variant is a dimer.

38. A method of treatment of cancer, comprising:
culturing or expanding the cell of claim 33, and
administering the cells to a human subject for treatment of a tumor.

39. A pharmaceutical composition, comprising a variant ADA2 protein of claim 1 or a catalytically active portion thereof, or a dimer or multimer of the ADA2 protein or catalytically active portion thereof.

40. The pharmaceutical composition of claim 39, wherein the ADA2 variant or catalytically active portion thereof is PEGylated.

41. The pharmaceutical composition of claim 39, wherein the ADA2 variant comprises the sequence of amino acid residues set forth in SEQ ID NO:273 or a catalytically active portion thereof.

42. The pharmaceutical composition of claim 41, wherein the ADA2 protein or catalytically active portion thereof is PEGylated.

43. A method of treating a tumor, cancer or non-cancer hyperproliferative disease in a subject, comprising administering to the subject the pharmaceutical composition of claim 39.

* * * * *

UNITED STATES PATENT AND TRADEMARK OFFICE
CERTIFICATE OF CORRECTION

PATENT NO. : 9,969,998 B2
APPLICATION NO. : 15/094908
DATED : May 15, 2018
INVENTOR(S) : Thanos et al.

It is certified that error appears in the above-identified patent and that said Letters Patent is hereby corrected as shown below:

On the Title Page

In Item (56) References Cited, in the list of FOREIGN PATENT DOCUMENTS at page 3, Column 1, Line 39, please replace "7/2007" with —11/2007—;

In Item (56) References Cited, in the list of FOREIGN PATENT DOCUMENTS at page 3, Column 1, Line 41, please replace "10/2008" with —12/2008—;

In Item (56) References Cited, in the list of OTHER PUBLICATIONS at page 7, Column 2, Line 73, please replace "PCT/U52015/055613" with —PCT/US2015/055613—.

In the Specification

At Column 51, Line 22, please replace "immunosorbant" with —immunosorbent—;

At Column 144, Lines 35-36, please replace "immunosorbant" with —immunosorbent—;

At Column 177, Line 5, please replace "immunosorbant" with —immunosorbent—;

At Column 178, Lines 28-29, please replace "immunosorbant" with —immunosorbent—;

At Column 228, Line 52, please replace "immunosorbant" with —immunosorbent—;

At Column 229, Line 43, please replace "immunosorbant" with —immunosorbent—;

At Column 99, Line 51, please replace "Tat" with —T at—; and

At Column 129, Line 4, please replace "proponamido" with —propionamido—.

Signed and Sealed this
Eighteenth Day of December, 2018

Andrei Iancu
*Director of the United States Patent and Trademark Office*

CERTIFICATE OF CORRECTION (continued)
U.S. Pat. No. 9,969,998 B2

In the Claims

At Column 297, Line 66 to Column 300, Line 6, please replace with:
—11. The variant ADA2 protein or catalytically active portion thereof of claim 10, wherein the variant ADA protein comprises modifications selected from among any of R219Q/S262N/R20N/V22S, R219Q/S262N/K371N/D373S, R219Q/S262N/K372N/I374S, R219Q/S262N/T403N/H405S, R219Q/S262N/G404N/P406S, R219Q/S262N/C105-T147del→(Gly)$_{15}$, R219Q/S262N/C105-T147del→(Gly)$_{10}$, R219Q/S262N/C105-T147del→(Gly)$_{7}$, R219Q/S262N/C105-T147del→(Gly)$_{5}$, R219Q/S262N/C105-T147del→(Gly)$_{3}$, R219Q/S262N/R125N/P126A, R219Q/S262N/S127N/K129S, R219Q/S262N/P126N/E128T, R219Q/S262N/R112N/I114T, R219Q/S262N/I134N/L135C/L136T, R219Q/S262N/I134N/L135S/L136T, R219Q/S262N/R142N/Q144S, R219Q/S262N/E137N/Y139T, R219Q/S262N/P111N/G113S, R219Q/S262N/F119S, R219Q/S262N/F119K, R219Q/S262N/Y224R, R219Q/S262N/Y224N, R219Q/S262N/Y191S, R219Q/S262N/Y191D, R219Q/S262N/F183K, R219Q/S262N/Y191D/Y224R, R219Q/S262N/F109S, R219Q/S262N/F109A, R219Q/S262N/R118D, R219Q/S262N/R118A, R219Q/S262N/Y139T, R219Q/S262N/Y139A, R219Q/S262N/W133S, R219Q/S262N/W133T, R219Q/S262N/P124A, R219Q/S262N/P124S, R219Q/S262N/V99-Q144del→(GGGGS)$_{1}$, R219Q/S262N/V99-Q144del→(GGGGS)$_{2}$, R219Q/S262N/V99-Q144del→(GGGGS)$_{3}$, R219Q/S262N/C105-T147del→(GGGGS)$_{1}$, R219Q/S262N/C105-T147del→(GGGGS)$_{2}$, R219Q/S262N/C105-T147del→(GGGGS)$_{3}$, R219Q/S262N/K371D/V99-Q144del→(GGGGS)$_{1}$, R219Q/S262N/K371D/V99-Q144del→(GGGGS)$_{2}$, R219Q/S262N/K371D/V99-Q144del→(GGGGS)$_{3}$, R219Q/S262N/K371D/C105-T147del→(GGGGS)$_{1}$, R219Q/S262N/K371D/C105-T147del→(GGGGS)$_{2}$, R219Q/S262N/K371D/C105-T147del→(GGGGS)$_{3}$, R219Q/S262N/C105-T147del→(Gly)$_{n}$ where n is 2 to 20, R219Q/S262N/K11A, R219Q/S262N/K11D, R219Q/S262N/K11E, R219Q/S262N/K13A, R219Q/S262N/K13D, R219Q/S262N/V99-Q144del→(GGGGS)$_{n}$ where n is 1 to 5, R219Q/S262N/C105-T147del→(GGGGS)$_{n}$ where n is 1 to 5, R219Q/S262N/N98-N156del, R219Q/S262N/C105-E148del, R219Q/S262N/C105-T147del, R219Q/S262N/V99-Q144del, R219Q/S262N/K371D/C105-T147del→(Gly)$_{n}$ where n is 2 to 20, R219Q/S262N/K371D/C105-T147del→(Gly)$_{15}$, R219Q/S262N/K371D/C105-T147del→(Gly)$_{10}$, R219Q/S262N/K371D/C105-T147del→(Gly)$_{7}$, R219Q/S262N/K371D/C105-T147del→(Gly)$_{5}$, R219Q/S262N/K371D/C105-T147del→(Gly)$_{3}$, R219Q/S262N/K371D/V99-Q144del→(GGGGS)$_{n}$ where n is 1 to 5, R219Q/S262N/K371D/C105-T147del→(GGGGS)$_{n}$ where n is 1 to 5, R219Q/S262N/K371D/N98-N156del, R219Q/S262N/K371D/C105-E148del,

CERTIFICATE OF CORRECTION (continued)
U.S. Pat. No. 9,969,998 B2

R219Q/S262N/K371D/C105-T147del, R219Q/S262N/K371D/V99-Q144del, R219Q/S262N/K13E, R219Q/S262N/K371A, R219Q/S262N/K372A, R219Q/S262N/K372D, R219Q/S262N/K372E, R219Q/S262N/K452A, R219Q/S262N/K452D, R219Q/S262N/K452E, R219Q/S262N/R20A, R219Q/S262N/R20D, R219Q/S262N/R366A, R219Q/S262N/R366D, R219Q/S262N/R366E, R219Q/S262N/H264A, R219Q/S262N/H264Q, R219Q/S262N/H264N, R219Q/S262N/H264G, R219K/S262N, R219N/S262N, R219A/S262N, R219Q/S262N/L221A, R219Q/S262N/L221V, R219Q/S262N/L221G, R219Q/S262N/E179D, R219Q/S262N/E179A, R219Q/S262N/E179S, R219Q/S262N/E179T, R219Q/S262N/E179V, R219Q/S262N/E179G, R219Q/S262A, R219Q/S262V, R219Q/S262M, R219Q/S262N/K11A/R20A, R219Q/S262N/K11A/R20A/K371A, R219Q/S262N/R20A/K371A, R219Q/S262N/K11A/K371A, R219Q/S262N/K26A, R219Q/S262N/K26D, R219Q/S262N/K26E, R219Q/S262N/R217A, R219Q/S262N/R217D, R219Q/S262N/R217E, R219Q/S262N/K258A, R219Q/S262N/K258D, R219Q/S262N/K258E, R219Q/S262N/R277A, R219Q/S262N/R277D, R219Q/S262N/R277E, R219Q/S262N/R283A, R219Q/S262N/R283D, R219Q/S262N/R283E, R219Q/S262N/K309A, R219Q/S262N/K309D, R219Q/S262N/K309E, R219Q/S262N/K317A, R219Q/S262N/K317D, R219Q/S262N/K317E, R219Q/S262N/K321A, R219Q/S262N/K321D, R219Q/S262N/K321E, R219Q/S262N/R352A, R219Q/S262N/R352D, R219Q/S262N/R352E, R219Q/S262N/R441A, R219Q/S262N/R441D, R219Q/S262N/R441E, R219Q/S262N/K444A, R219Q/S262N/K444D, R219Q/S262N/K444E, R219Q/S262N/K461A, R219Q/S262N/K461D, R219Q/S262N/K461E, R219Q/S262N/K469A, R219Q/S262N/K469D, R219Q/S262N/K469E, R219Q/S262N/K470A, R219Q/S262N/K470D, R219Q/S262N/K470E, R219Q/S262N/D86A, R219Q/S262N/D86C, R219Q/S262N/D86E, R219Q/S262N/D86F, R219Q/S262N/D86G, R219Q/S262N/D86H, R219Q/S262N/D86I, R219Q/S262N/D86K, R219Q/S262N/D86L, R219Q/S262N/D86M, R219Q/S262N/D86N, R219Q/S262N/D86P, R219Q/S262N/D86Q, R219Q/S262N/D86R, R219Q/S262N/D86S, R219Q/S262N/D86T, R219Q/S262N/D86V, R219Q/S262N/D86W, R219Q/S262N/D86Y, R219Q/S262N/E179C, R219Q/S262N/E179F, R219Q/S262N/E179H, R219Q/S262N/E179I, R219Q/S262N/E179K, R219Q/S262N/E179L, R219Q/S262N/E179M, R219Q/S262N/E179N, R219Q/S262N/E179P, R219Q/S262N/E179Q, R219Q/S262N/E179R, R219Q/S262N/E179W, R219Q/S262N/E179Y, R219C/S262N, R219D/S262N, R219E/S262N, R219F/S262N, R219G/S262N, R219H/S262N, R219I/S262N, R219L/S262N, R219M/S262N, R219P/S262N, R219S/S262N, R219T/S262N, R219V/S262N, R219W/S262N, R219Y/S262N, R219Q/S262N/L221C, R219Q/S262N/L221D, R219Q/S262N/L221E, R219Q/S262N/L221F, R219Q/S262N/L221H, R219Q/S262N/L221I, R219Q/S262N/L221K, R219Q/S262N/L221M, R219Q/S262N/L221N, R219Q/S262N/L221P, R219Q/S262N/L221Q, R219Q/S262N/L221R, R219Q/S262N/L221S, R219Q/S262N/L221T, R219Q/S262N/L221W, R219Q/S262N/L221Y, R219Q/S262C, R219Q/S262D, R219Q/S262E, R219Q/S262F, R219Q/S262G, R219Q/S262H, R219Q/S262I, R219Q/S262K, R219Q/S262L, R219Q/S262P, R219Q/S262Q, R219Q/S262R, R219Q/S262T, R219Q/S262W, R219Q/S262Y, R219Q/S262N/H264C, R219Q/S262N/H264D, R219Q/S262N/H264E, R219Q/S262N/H264F, R219Q/S262N/H264I, R219Q/S262N/H264K, R219Q/S262N/H264L, R219Q/S262N/H264M, R219Q/S262N/H264P, R219Q/S262N/H264R, R219Q/S262N/H264S, R219Q/S262N/H264T, R219Q/S262N/H264V, R219Q/S262N/H264W, R219Q/S262N/H264Y, R219Q/S262N/S266A, R219Q/S262N/S266C, R219Q/S262N/S266D, R219Q/S262N/S266E, R219Q/S262N/S266F, R219Q/S262N/S266G, R219Q/S262N/S266H, R219Q/S262N/S266I, R219Q/S262N/S266K, R219Q/S262N/S266L, R219Q/S262N/S266M, R219Q/S262N/S266N, R219Q/S262N/S266P, R219Q/S262N/S266Q, R219Q/S262N/S266R, R219Q/S262N/S266T, R219Q/S262N/S266V, R219Q/S262N/S266W, R219Q/S262N/S266Y, R219Q/S262N/K267A, R219Q/S262N/K267C, R219Q/S262N/K267D, R219Q/S262N/K267E, R219Q/S262N/K267F, R219Q/S262N/K267G, R219Q/S262N/K267H, R219Q/S262N/K267I, R219Q/S262N/K267L, R219Q/S262N/K267M, R219Q/S262N/K267N, R219Q/S262N/K267P, R219Q/S262N/K267Q, R219Q/S262N/K267R, R219Q/S262N/K267S, R219Q/S262N/K267T, R219Q/S262N/K267V, R219Q/S262N/K267W, R219Q/S262N/K267Y, R219Q/S262N/V296A, R219Q/S262N/V296C, R219Q/S262N/V296D, R219Q/S262N/V296E, R219Q/S262N/V296F, R219Q/S262N/V296G, R219Q/S262N/V296H, R219Q/S262N/V296I, R219Q/S262N/V296K, R219Q/S262N/V296L, R219Q/S262N/V296M, R219Q/S262N/V296N, R219Q/S262N/V296P, R219Q/S262N/V296Q, R219Q/S262N/V296R, R219Q/S262N/V296S, R219Q/S262N/V296T, R219Q/S262N/V296W and R219Q/S262N/V296Y. —;

At Column 300, Line 7 to Line 11, please replace with:
—12. The variant ADA2 protein or catalytically active portion thereof of claim 1, wherein the variant ADA2 protein or catalytically active portion thereof comprises amino acid replacements selected from among R219Q/S262N/K371E, R219Q/S262N/K371D, R219Q/S262N/R20E and R219Q/S262N/K371D/R20E.—;

At Column 302, Line 62 to Line 64, please replace with:
—21. The variant ADA2 protein or catalytically active portion thereof of claim 10, wherein the sequence of the ADA2 protein is set forth in SEQ ID NO:273.—.